United States Patent 10,407,724 (METHODS AND COMPOSITIONS FOR SCREENING AND TREATING DEVELOPMENTAL DISORDERS) - sequence listing, part 67

SEQ ID NO: 1859 - DNA, 2009201 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgtgaagagaaagagctgctgggatgctgaatggcacatcagccaactttgtgtgtagcaaaggctctaaagaaatcctgggctgaaactctgctggatcatggattggactcaatttcactccacacacagtctgcattacctgatggagattatttctggaagcacttagggcatgtttgtctacaaaaagatagggcctttttctttccttaacaatttaaaaaatacggtaacaaaccagagacctgatactttaaggaagatcatttattgtgagctccatgagggcctcaatggtctgtttcgaaattgcagccccagcatctagaacacagtcagcacttgataaatatttggctaaatattaaatgctcaattgatatcaggttcaaattagaatttgctaaattatttacacactgtaatgaaagtaaaaaatgcaaggtttgctgaacagctccagagggttaataagagtgtgtgtgtgtatccttttgtcattcaacacacacacacacacacacacacacacacacacacacacacacctgtatagctgatgataaatatacattatatcaatgagttaaaataaagtgtgctattcattcactgagcaatggggctattgcctgggcacggtggctcacgcctgtaaacccagcactttgggaggctgaggcagatggatcacaaggtcaagagatcgagactgtcctggccaacatggtgaaaacccgtctctactaaaaatacaaaaattagatgggcatggtgacgcacacctgtaatctcagctactcgggaggctgaggtaggagaatcttttgaacccgggaggcagtggttgcagtgagccgagattgcaccactgcactccagcctggcgacagagcgagacttcgtctcaaaaaaataaataaatttgtaaaaaaagatttaagcaaacccactgataacaatacttagaaagtttgttgaaaaccgtatgtattatttgcttattgccctgacaatttctaatatcataatagttcattataatagcccattcctcagtgaatgaatagcacacttcatttgaactcattgatacaatgtatatttatcatcagctgtacaggtgtgtgtgtatacgtatacttttgaatgacaaaaggatacacacacacacacacacacacacacacacacacacgcacgcaattattaaccttctggagctgttcaccaagccttgcattaaacctggattgaataaaagactcccattcctcaaggaaattttacttcttctatgaggacttctcagtaaccctaaattcacaggcatattctttacatgttactgtcccaaagcaaaatgcaagctggcatggaaccaagcccagaggttaattcctgaagctagaggaaaaggttccaaagtgccctacatcccaaggtcgcccaacagatccacacctggaagcaatctccgccaagcgcctatttacaggcacaggtgtgtgcctatcgggacagctgaggaacacacctaatttgatagatgacattctgatgtggcaggctttattgtgctgtttatgacaatatctgcagattatgatgtgcttgtttaataaacagcgtaattaagcacacacaaaacaaaacaggaagttaatacctaagtggtgctgacgtgtttatgtaccacaactgactagtgtattctttactgcctattactccacttcttaatatccactgaaggaatcctcagtctgtatacacacatctccaagttatgaacatcaacttcatgcatatcctcagaaagacctacttacacctgcagcctcaccacatatatctacacccttaacaggcattcaataaatacttgtcaaatgatcagataaatgataaatgaaggagaaacataccaatatttatatcttcaagattgctcctatgggcatataattttacaggagttgctacttggattgtctatcttttcagtctacattttttctctaaaatataattggcagttgccttatggatagattaaatttgatagagcctggtacttgaggtgctatttcagcaccatttctgtaattctggaactagttatcaggcttggcagatgcaaatgtatgcagttttgatcttcttcccgactctctaactgcagattttacaactgaagaaagcaaggggaacttttatttataaataatcgatacaatttgtaaatagaaatcctttccctctgagcagctcacagccagccagctctcagatgaaggtacgtcagctctctcttgactaatggtgtggtctgcatcatggaggttaccagacattccttggcagaatgcaaatcaaacatcttgaatggcaaaaggatcaaagcacggcatctaaacattgctcagacctgctgttcatatttttatgcatcagaaaacttgaaagagaaattagaattgaaagataatgcacctgcaccttccaaagtgtataatattgagatttttagcatatttgtccctctgggattagtatattttattccattgtagggcagcagctgaacaggggtttgtggaggcagaagacttgagagcctcttggctcaactacctgtaagctgtttgaccttgtacaagtcatttaaactttctggcttcaacttccacatccataagtggaattaataatacctcatcaagtgatgagaatggaatagatattaaagcactgctcctcaaaatttaatgtgatacaagccaggtgtggtggctcacatctgtgatcccagctacttaggaggctgaggtgggaggatcatttgagctcaggagtttgtgaccagactcggcaaaatagcaagaccccatctcaaaaacaaataaagaaaaatgcatcgaaagtaaagaaaaaagaaaaaaataataattgaatacaaatgaccttaaaaaaagcagagtttaattcattggacctgcggtggtgcctgagagtctccatttccaataagctcccaagtggtactgctgctctgtggaccccactgtgtgtagcaaatatcagtggaaaacactgttattcttccaaatgatagtgaatttgtgtcctattgccatttttatttggtgcatgttttccctcagtatctacccaaccgtcaattactagatgcttgtctacggcaggtgatgtgcaggacatagatattttaaagtttacaaagacattgccctgtcctcaggaagctttcaatctatgtgagaatgaagatcacttaccactacaaacagtttggacatggaggaccaaagctacctaccccttatgctcacatagctggctgtcgacattaacatggtttacctttccattgtcttcattagcataactttcctattacagataactcttggccaggcaaataatttgactgttcactaaagtaacttccccaaactcccatcaactcttcaacaaaaaacatcaatagagttcacaccttaatagtctctgagcctcttggctagaaatcttcactgtgctgtttccaccaaactaagttgtaataccatgatccttacccaatcctaattgtgcccccacagtgaaagaccaatcttaaaccaagcttcatactcccaatgaaatccaacctcacctttctccttatgaaatactaccaaagctttgtccaggctgtggtctttcttaccatagtaagcaataaatttaactttgtcttatcaacaggttgtattggtgatgtttagggagctgaaatttcccatatggaagaaatagacatgggaatcaaacgtatgttacaaggagataagcagtggtgccaaggggtggattaaaagactctagctccttttttgtcataacaaataaacatccaatttaattataatcagtacattttttctctgcaaacttagtttaacaacaagtcccctattctcctcttatttactcacccaggcatttggatgttatcactggtgccatcattgattgtgataaaatatttgataagttttatgtcctcaatgcttcattaacagtataatacatgagagtgacattaaccaagattaagggagaaggggaaatcttttggtggttgtgatgtcaaacctaaaactacatggaggcccagaattagggaaaattcagcatccagacagacaatgtaagatcacggtattttcagggaaaaacatgaaccggagcaaaagctcaaaatggggaaagagcgagagagaaactaagggtctaaacagtcttttatgtcaagttaagtggcttatgtctttgctacccaaagtatggtctgcaggccaaaatcattgctataaccctgagcacttgctagaaatgcagaatctcagacaataccccagacctactgaatcagcatcagttaattaagaaaatccccaggtgattctgatgcacatcaaagtttgagaagcactattcaaaataatatgctggaggctacgggaagctactgaaggattttaagaagggaagtgacataattgaatttgcattttagaaaaaaaattactctgtgtccattcattccttcaggatatatatgccaagcattgaccttagagctggaaattcagcactattttgagtggattagctgaaactccctattcagtattcattcaatgaacatttattgcattccaactttggttttttttttttttgtttgcgtgtttgttttttgcttttttgaagacagggtctcactctgtcatgtgggctggagtgcagtggcatgatcccggctcactgcaacctctgcctcccgagttcaagtgattctcgtgcctcaggctcctgagtagctgggattacaagcatgcaccacaaaagccagctaatttttgtatttttagtagagatgggggttttaccacgttggccaggctggtctcgaactcctgacctcaggtgatccgcctgcctcagcatcccaaagtgctgagattacaggcatgaaccaccatgccccacctgcttgcaaactttcatttgacttttccaaaagcttgatttggaaataatcccacactgatggctatgtttttaatggagtcaacctttgttgtccaggacaaataactgttaagaatcttctagcatactgtactcaaagtccttagcactatcaggctgttggctcaaacatgaaaggtttttttgatgtagttttgtagaattgttattgcaatggtatttgctgtattggaatttgacccacagtacaagttatagtacaagataccaatcaatattgttttttgttaatgaacaacataagatgtacagcttgccaaatctaaactttaatattagagattataggatcagtaccattttttgctaacctatgcagaggattgtcctttggtgactgaaaaggaaaacaataaattcctacttatgtggagtctctgtctttttaataatagtcagtgtcttattggaactcacaaagacttggtgtgaagagctctgacaagctagttagcctattttatgcttgttttattcttgcttcctatatgcaaacatagtgaaggacagcgggcaatgagctcgcacttctattttagcgattctgggttactcgggctgcctctaatctaccaagccaggattattataaggaaaataaccaatgtagctaaagataaagtcatcacttccctaactcaattcctttgtagctgcaggaacactaaatttcattcagaattctaactcccaaaaagctgggtaatctaagacccttaatggttttcttatagcctcatagggtttggcaggtgccctggacatctggcagattccctgagagaacaaaaactcagaagctaccaaagattgaaatactcccttcaatacccaccaactaggggagcttatacaagaccgtgggtttctttctactttgttcttttatttacataatagcaatgataatatctttgttgtagaattactcggaggattaaatacaagaaaatatttacagtacctagcacttaataaactctcaatatatattaattttccccactcccttctgggttactaagacccctataaaatgcaaatttatttacatcacagtagtcactaatatttttgaaaagttgagttaattgaattaggaagcctgttataaagaataagccctgagtaaagaggatgtgtattatgttctctaaggtatgtgaagtgtgtgaaaagaaggtccaaaaaaggagggcttgcttgagatgactgatatccaagaagatagtacaccctagctgtcagaaccattgactttaagggctgaagatatcataaaactatccattttgcagatgaggacactgaggctaagttcggtgaaataacttgcctaggccttagagttagaacactagcaaggcaggattgaaacctagtgaatgagaggcttcaaaaagaaagaaaacaatgtggacacagggaaaaggtgagggagagcattaggacaaatacctaatgcatgtggggcttaaaacctagatgacgggttgatgggtgcagcaaaccaccgtggcaaatgtatacctatgtaacaaacctgtacattctgcacgtgtatcccagaacttaaagtataataataaaaaagaaagaaggaaaacaatgtgaagaatgaaagcaggatagggaaggagggagcgctacagctcagggtgaagtcttgtatcccctttgcctctgtccccttagtagtaaatatttctcggggtgaatcagtaacatccctcagcctctcatacagaagtgccagagtgtgatctggctattctgccattaaacattcaagatcctctacaaccatgaacatagaagaatgatttatccttatgttcttgctgtatcaaagactctcagagattttcagagacatgccttttccatactgatcaatgaagatgggtcaccagaaacatcgtagtcaaagtgacagtttttgtactgccttcccagataattttacagactgacatgaatttgaagcaacaagcttttttttttttttttttttttttttgaggcggagttttgctcttgttgcccaggctggaatgcaatggcacaatcttggctcaattctcctgcctcagcctcccaagtacctgggattacaggcatgtgccacaacgcccagctaactttttttttttttgtatttttagtagagatgggggttcaccaagttgatcaggctggtctcaaactcctgacctcaagtgttccacccacctcagactcccaaagtgctgggattacaggcatgcaacaagcatttttatgaagaccctgcctgaatagccattcattccaaggggacttgaatttgaataatacctccacacagatgactctcaaatctgcatctctagcacatacttcttccctgaatcccatactttcatccaactgcactctttgtgactttactgggatgtctaacaagatttcaaacctaacaattccaaaacaaaattattgcttccacctttacccctctaccatctaacttgatccttctaccattttctcaattctattcaccttatccaccttggactcatcctgggctcttctctttctttcccaccccataccccattcatcagcaaacctggtagtgctaccttccaaaaatacccagaatccatgtacctctcattgttttcactgaaagcttcctggtttagaatcaccattatttctcatttgaattattgcaatgactccctctgcttcaataggtactcttactctctgttctccactccgtggctagaacaattcatctcctttctttccccaaatgagtttacttagaaaactcccttgaaaagacaaaatcatagagatggagaacagattaggggttgctagtgattcaggaagtagaatgggagattggatgggtgtgacaattaaagggtggcttgagatagttcctttgtgacgctggaactattcagtaccatgtatcaaaataggggtagttgttatatgactctaaacatggtataaaattgcatagaatgacagacacagataagtgcatgtaaaagctggtgagatctgaataaggcatagattgtgttaatatcaatttcctggtttttatattgtgcatagctatgtaagatgtgagatctgaataaagcatagattgtatcaacatcaatttcctggtttcctggctttgatattacatataattatgtaagatgtaaccattagctgaagatgagtgaagggtactcatgatctttcttaatacttttgcaacttcctgtaagtgtatatgtatttcaaaataacaagtttgaaaaatactgcatatacacggcattcctcaagactacggattttctgtttcttctacctggaatgctctttccccaaatatgtaaatggataatttctccccttccttgagatttctgttcaaatgtcacctcatagaggtctgcccagagtgtcatacataaaatatcaattttggctcggcacaatggaccatgtctgtaatttcagcactttaggggtggaggcaagcagatcgcttgagcgcaggagttaagaccagtggtactgaggtagtgaggtactgctataaagatacttgaaaatgtggaagcaactttagaactgggtaataggcaggggttggaacagttaggaggctcagaagaagacaggaaaatgtggaaaagtttggaacttcctagagacttgttgaatggttttgaccaaaatgctgatagtgatacgaacactgaagtccaggcagaggtggtctcagatggagatgaagaacttattggtaactggagtaaaggtcattcttgctatgactaacaaagagactggcatcattttgaccctgacctagagatctgtggaactttgaacttgagagatgatttaaggtatctgacagaagaaatttctaagcagcaaagcattcaagaggtcacagagcataaaagtttgaaaaatttgcaacctgacaatgcagtagaaaagaaaaacccattttctggagaggctggctgtagaaatttgcatatttaacaaggagcccaatgttaataggcaagacaatggggaaaatgtctccagggcaagtcagagaccttcattgcggctcctcccatcacagacccagaggtctaggaggcaaaaatggtttcgtggaccaggtcccccccccaaccccaccactgtgtgcggcatcaggacttggtgccttgtgtcccagccactccagccatggataaaaggggccaaggtacagttcggaccattgcttcagagggagcaagtcccaagctttggcaactgccacgtggtgttgagtctgtggatacacagaattcaagaattgaagtttgggaacctctgcctagatttcagaggatgtatggaaactcctggatgtccaggcagaagtctgctgcaggaatgaagacctcatggagaacctcggctaggacagtgtggaagggaaatgtggggttggagccccaacacagagtccccactggggcactgcctagcggagctatgagaagagggccactgtccaccagaccccacaatggtagagcgatcaacagcttgcaccacgtgcctggaaaagctgcagacactcaatgccagcctgtaaaagcagccaggagaggggctctaccctgcaaacccacaggggtggagcttaccaagaccatgggaacccacctcttgcatcagtgttacctggatgtgagaaatggagtcaaaggagacaacttcagagctgtaagatttgactgccctgatagattttggactggcttggggcctgtagccccttcattttggctaatttctcccatttgtaatgggtatatttacccagtgcctgtgcttccattttatctaggaagtaactaacttgcttttgattttacaggctcacaggcagaacagacttgccttgtctcagatgagactttggacttggacttttgggttaatgctgaaatgaattaatactttggagtactgttgtcaaggcatgattggttttgaaatgtgaaagggacatgagatttgggaggggccaggagcaaaatgatatgtttgggctttgtgtccccacccaaatctcatcttgaattgtaatccttataatccccataatccccaggtgtcaaaggagaggctatgtggaggtaattgaatcatggggttggcttcccccatgctgttctcatgatagtgagtgaattctcccaaaatctgatggttttataagggtctcttccccctttcctcagtacttctccttcctgccaccttgtgaagaaggtgcctcgcttccccttcattttctgccatgattttaagtttcctgaggcctccccagccatattgaactgtgagtcaattaaacctctttcctttataaattacccaatctcgggcagttctttctagcggtatgaaaacgggctaatacactccctctcttgagatttctgttcaaatatcacatcaaagaggtctgcccagactgccatatataaaacatcaatttcggctgggcatggtggttcatgcctgtaattccagcaccttaggaggtagatgtgggtggactgcttgagccccggagttcaagaacagcctgggcaacacagtgagactctgtctctataagaaaagaaaacgtgttagctgggtatcgtggtacatgcctgtagacctggctacttgggaggctgatgtgggaggatcatctgagcccagggaggtcaaggctgcagtgagccatgatcacgtcactgcacaccagcttaggcaacagaatgagaccctgtctcaaaaaatatatataaataaaaaataaaacatcatgttcctgtcactttttccctatcttgttagtttctcttttcttcttaacactttaatacttccatttgaaataccacatatttattttctcctttcctaacttcccattactatatgagctccttgaaaggacagcgtttgtctgtttttggttatccttgtgcctatattagtatgtggcacacaatagtcactctacaaatatttgatgaattaataaatgagtgaacaggtaaagctagtagaaggaacagtcatgcagattggcttaataggaaatacaagtctgacaaaatcacattccttggcagtacttaaaaaaactgggaaggaaaaagaaaacttgctcctgctgcttctgtgatacaaagaaaaacctcattattagcagtttttttaaataataaagttgagcattaccatgtagaatggtattatggacagaacacaccacatatgtataaaaataagtaacttccctgggaagaatcaatacagatagtccctagattacaaatgagttgtgttctgcacatttgaaagacagctgcttaatgatctgctcgatgctctctaaattttctgaccgggttcacttcacccctacctgtgcattcagtcatactctattccctggaatcaccaaacctgtacctaacagaggaattcaatgtggttacatttcataggttagtccacaaaataatagttcacttataaacgagctgaagtatagtgtaaataatgctggttttaactctgcacgttgtaagtaattcaaatgcttagagttgtatcacatttaatggtatatttacctgagaaaggcaatattaaacgtgcaaggaaatgtgggccttgaagtcaagtacactttgaaatcaaactgtcactctgatgctacctttgtgatgttggtccagtttcttaacttcttgaagccttaatttcctcaactgtgacttggagatgatcattgagactacccaccaggattgttttaggattaaaggagataagtcttcagcacagacttagtgttccataacattacatcttattatattgagcacttccagttagtctgagttacaaatgatattttacacatcatcgtaaaccaacggtctaacaacgtccctgatacacggttaatgctaaatatgtgaggtgaatgaatatttaacaagtacattgattcacatactggagagggatgaataggcatgaaggacaggcacgaaggcctttaatgtttgtgagcctatccatctatgatgttttccttttaccttcctcccattaccttctaattctctactcacaggtttgctaaaagatctctcttccaccaccactccttgtccccacagtgggaggagcatgagggaaattcaaaaataaataccacttatgtagcattttttggttggaattttagggtcaatatttagttttaaaatgtgttaaatgtacattttcattaaaaagaaaagaaaacatgatttatacaagataagcatgacttcttcactgctgcatctttttgaccttagtttatagaatctcaactgcagcctggggcctgccccatctctgaagaccgtgctgcccaaaggatgaggatatgaagtaccctgttaaagtaattcattggcatgactgcttggtttgtcctggattaatcatctctctcaaggagattttagcccatcggcccattcctgtgcaagatgcctaacctgattcctaggctcccaagctagaatgaagatactagctacaagtcctccccaatgctagactaacatacaattttgatctctggaattctagtcaatgatcctaccaatgtgagctctacctcttcatggcccctaaacgctgatatctgctttcagccttaccatataatgctcttatgctcttcctcttgaaacacatgttaagaatgacccatcttccctttggaagagtttaagcagttttcataatctctttaaaaaaatttgactggcatcaaatcaagctctgaccaatgacagttataaaaaaaaaaaaaaaaaaaccaacaaaaaaactaaattccctcagagaaaacaggaaagtatgggagcaactttaagaaaacacttggaataataacaaactgttacttaatatttaacctatcttttccccgaagggctcaagctgattattttcttgcttttgacggctagtgaaaataattggttcctctcttctttgtcacctccttgaactattaagttttcccttgatgttttctcatgcatgaatatgccagtaccacttacacaggtcttgtaaacaagtttcaaaagctattagacccacataaattacacaaaatatgtttcagtccctaccaaatttcctaaagccatagttcgtctgtccacatcaacccactcccttcttttattatccctgctttagctaccttgtcactcaaataaactgtgtaattcacacctgctttgagctgattggttgatctgtccttgattgtcccaggtggatttattctcccttaagcttcaggtaggaatcctgcaggttcatacctggagaaggagataaacctatgccttaaatgcaatgttcattaatggataaattcataactggcaatggtaccaagagttacagcatcttcctctattaaaagcagagcagcctatgggatggccaagtccttgaaggtgacagggatttgacaaaaatggagggtatgaatgggctatattatagttaatgatttgaaatcattgtttagaaataattgcctagacaagataagttaactgatctctacaaacttgcattatatatatttctcatcactatgcataatttttattatagatttgtcccttgaggtccagaagcacaaagcattctcatagtcccccaacaggcatctttctttaagagacaaagcaaggcaataaaaggggggtattttatttatcgcccaattcacagcatttctgtcttgactctgagaagtgtaaattcataacaggaggtttctagacatacatatagaaggtgatgctggtgatccaaaaaatattgacaattgataaagaaatgctgaaggaggtgtcactattactagaagtaaaagttttaacaataacaataaatgaggcctctttctgtgtccatctgtccacaatcccatgccatctaccccttctctagagttgccatggaagagaaagttccactacttcagttacgtcatttctatttggaggaaagatgggggtcattttttctaattgaagagtgttgtgacatttttttcctcgcattgtttcatttcatttcgacttatcttttttcccacttataatgtgcatattattttttgacatcaagataatgacaataaagaaaaaaaactcactgtcttctcaattttaaaagaaaaaatagcaaggaaaaatgatcagctaaaggatttaattttaatgttgtgataagctatttttctaaatgattttccacataatctgtgctttagcaaagatcttctcttttttttctagtttccatctgagattagataatgggctgtatcccattatgtgcatgctgtaactccaccacacctgttacttttgacatatttttatatttctcaataattaaaaaagaaagagtgggccaggtgtggtggctcatgcctgtaatcccagcactttgggaggctgaggtggatggatcatctgaggtcaggagttcgagaccagcctgaccaacatggtgaaaccccgtttctaccaaaaatacaaaaaattaactgggaggggtggtgcacacctgtaatcccagctattcaggaggctgaggcaggagaatcgcttgaatctgggaggcagaggttgaagtgagtcgagattgtaccattgtactccaacccgggcaacagagcgaaactccatctcaaataataataataataattattattattattactataagaataaatggtagcttatttttacctaaacgtagtagtggcttcatgccacagttgctaatctctgagccatctcactatcctttgttcagcttgttaaatgtctctatactttcgtaactagttcctcatagtaaattccttcttccagaccagtgtttcccaacctcaccacaactgacattttggacagaataattctttgttgtaagagactttcctgtgtcctgtacagtgtctaccaatatctctgtctctaccaaatgaataccagtaacactcctgcaattgtcacaaccaaaaatgtctccagaaattgccaatttatccctcagcgtgcagcagaatcacccctggctgagaaccactgtattagactagaagatctttacttttctgactgactcctaagtgatatactcctttcaagcgcatatttatacctgttatatgtaaaaataagattggaataaaataacatctatctatctgtgtccctataaaattagtcatactgtggtgatatctacatctctataaaactagtaatattggtaaacaataaaagcttattcagcaaatgaatatattgatatgaaaagatctgcaaaaccttgatctactttttccaaaattaatacatattttattttgtccagctaatatttaatatatttttatttaattagccatcatagggcctttgaaatagttcatacattatgatgccttatatactaaagtgagtaaaattaaacatctgttaatacggctgacacagaaaaacacagtcagataggcagttttagagaggagaaatatacaataatagttcttctttttcccacctcacattatgaacagggaagtttttccttagcactaacatctcagcaatacgtaaagatatcacatcccttattttgtatttattaatccttcttttaatgcttctgttgctaattttttaattgactttgtccttaccgaatactagtgataggatttataaaggatgattaagtcatggactaatttaaactttgttgaactcatataacagtgagtttcaatgaaatcacactaagaattctctgtaatgctttgttccagctataagaaaacaatacccaatttcatctaagagatgaaaaataaagaaagtatgtgaagataatcatattcaatagttattatattatgataatttgcatatgtagacatccttgaaatgtacatagacctttattcaagatctttcccatacatttcagaattcgtttttatcattcatacatttgataaacatattttaagtgtaatatttatcttatcaacatgtaatgcatacttaacaatgtgtaatattgatcttatcaatgctactctaccaaaattaaaagtagatcattaaagaaaaaaatcaaattcctcttaatgtcatagaaaaacattcttctctattaagataaaggacaacttaataaatctaatattttcatagctcatataaagaaatatagataggattagacaaatagaaggaacaaatgaaagcccagtagattaccagtgttttgagccttaatttaggaagttatcaaatatgtacttattcatttcagggaattgtatggtttcagaaataagaaaagcgacaacaaaacggtcaaatttgcctgaatgattggtcagctttgttcattctaaacttaataatcctttactaattcagcaaagtcttataaaaaatttatcaggtcattgttcataatgatatgagcaaaaaggaaatggaaatagataacaggtcatatgatggatttcattcaaatgttataaggcattttgtgttaaatatttgtcattcatattacatagaaatataatttatgtagaggaatgtaataaacattactctttttaaaaacatcagtttccgaatatgccacagaatcttaatttgattgaaatgccctccctctcccttctctcaacagtgagtcttattttgtgttcaatagcaactaaatgtttccagactgtgaagcctttctcaagtcccacaacgggagttatatctgtcacctatgatcccacagcaccctcttcatcctctattataaaatactaccattttagacttatactctatagtgttctgattttgcccatatgcctaactcacacatgagatcactaaggccagaaaccatatgttattcaattttctgtttatgtggccagttccttacaaccttgcttatataaagaggacattcacaacatgtttataaaattgaattcagctgaaaatttttaatgagtttgcactgagaaatgagataaaacttgaaggtatttgcatgataactgaaaagctgtggatcaaatcaaagatcatagaggtatcttggaatacaccacagtttggaggtatcagaatgatctggctaagtatttgttgcagtataggattttgttttaaggacattaactgctcaattaaaaaaaaattggactcaattttattttcagcttgtgatacctgattttggtgtgtgtgtgtgtgtgtgtgtgtgtgtgtgtgtgtgtgtatgtgtgtacttttacattttcagcagcatgtggcaggtggctttttagggtacactattcctgtgacctgttgacgtgacaaagaggtcgttggagaaaaaaatcactcctcatgagtacagtagtatcccaagagaggcagatcacactcacacatgacataagaatcaagttttactgaaaaatcatagaggtgtttttagtaaagcaattaagaaaataatctttttcttatatatttctgatgcttcctaaaaattattattatgattatgattattattgagacggagtctagctctgtcaccaggctggagtgcagtggcgcgatctcggctcactgcaacctccgcctcccaggttcaagtgattctcctgcctcagcctcccgagtagctgggattacaggcatgcgctgccatgcacggctaatttttgtatttttagtagagacggagtttcaccgtgttagccaggatggtctcgatttcctgacctcatgatctgcccacctcggcctcccaaagtgctgggattacaggtgtgagccaccgcaaccagcctcctaaaaattatcttataaataagactaatcaattaaaatattttaaagatatttttcttctaactatacttccaaatatttatatgtatgctttaggaaattgagtttttaagtgaaatattaaagacatctcattttcctgttacctgattactgttcattcaacctgttgctgtattgttccatttttatatgatataccataagaggctatgtgtgaataaggcaatatacatgatgcagcattactttgtattcacattttcaaggtgtatagaaaatttttaaaaagatgttaaaaaggtaaataagttcattgttaattgttatagaaagagtagacaagagagaagactgagtctacatttcggcaaaaagtcttcataaaaattagaaaattggtgagtaagtcaatgaagcattgtcaaagtcacaaacaaaaggtgactccacattattataattcccctgtcagaaagtagacatggcaaacttatgacttcaacctctgaaaatgaggatcacagaggagaaataagactggacaacaggcttccagctgtgtttctaacaagtataattacactggttggacattatcattaactacatttctaattcttctcataattcaaaaagtgagagagaaaaaggaagggataactctttttggtgttatagtacctcattgtaggtttccaaaaacaagtgactcctgacaacaactgttagctctgaagtgagagtctgcaaactgcagccctcaagccgtaactagcccattgccatttttgtaaataaagttttattggatcacaatgacacatcttcatttctctattgtctatgactgcttcaacattctaacagcagagttgaatagttgcaacagagtatagaaaacaaagcctaaaatatttactctctggccctttacgtttacattacagaaaacacttgctaacccctactataaaacaatgttgtctttggaagctatggtaaattaaaaacagaataaaactattgctcacgtatattttattttcaaagtaaaattacttttttccccttctatagatattttttttttttcctggaaggagcttccaatttcaagcaagaacagaagcagaagcactccaataagtgtgcttggttacatgaataacttgtgatggtttggatatacttcctggcaacacgcaatgttagaaacctagaaatatgtctgcctggtacttttaaggggaatatatagagagcctcttttgaaactttgaaaagatttattttctattctggagacattttagtatggagagttgaaggttgcataaaaatacagcaactaagatagttggaatagttattctctagggaaacatttggccctaagacaagacatgttggaaacacataaacaagcaaataaaattggcaaatgtaagttttgattcatatatgctcgtgaaactatattcttaatgctattgagaggtgaggccagctggactttctgggtcgagtggggacttggggaacttttctgtcttacaagaggattgtaaaacgcaccaatcaggaaccttcccgtcttacaagaggattgtaaaacgcaccaatcagcgctctgtaaaatgcaccaatcagtaggattctaaaagtagccaatcgtggggaggattgaaaaaagggcactctgataggacagaaatggaacatgggaggggacagtaagggaataaaagctggccacccaagccagcagcggcaacctgcttgggtccccttccacgttgtggaagctttgttcttttgctcttcacaataaatcttgctgctgctcgctgtttgggttcgtgccacctttaagagctgtaacagtcaccgcagaggtccgtggcttcgttcttgaagtcagcgagaccacgaacccaccggcgggaaccaactctggacacactatgaccttaagtaagtctgtcttcatggatcctagatatttcctagcctttgtatcttccttaaaggttaccttcaggtgcttttgaagttgttatgaccacatgtacagtccttaccttttgtacatgaaactcaacttttgattcctattttatgtttccattagatggctacgtatgtaaacaaaaaaagtttttgtgacactcaggcattactacggagggaggtgaacgttcattaagacatttatctcaaatattgcatccagaagaatgacactaagaataaactcaattgaagtatgagataatgtgcttcaaagactaagggactaaataactcatcctcttcctaattaccttatagataccttagttctctttatccttctccaacatacaaagctagttcatttttaaggtctttgcataagctgtcccttgtgcccggaatgctttgcccctacatcattacatggctgactctagtttgtccatcagttcttcttcaaaatcaccttccaagtgaggtattgaagactttttcaagatttttctcttttttattaattctgtgcataatatttcccactttctaaattgttttcctttctcagtttgtatcctatccctgcttactaaaattacagtttcatgagcacacgggacctatgcttccttgtacgtagtgtgcaggatattacttggaatatagtgggcacccaatatattaatgaatacaatcattgtagaaagttaaatccacagtggtccagatgtggtgttaagcatgaacctaaatcttctaccttcaaggtgctcctaatatggttgggttgatgatcacatacaaatcagataattataccacttgaggaacattaggtttacaaactaagcattattatatcattttattaaaatgtattcatatcagtaaagtggggacggtggagtcaaggaagaagtattgtaggtgacattttagctgagtatagaaagggaggttagggatgaagcaccaggcaaatgcttgtcacaagtgaccttgtgagtcacttgtgacatgaagtgagtcacttgtgacatgaagctgtataacgtgcttagaggaagacatacagttcatcacggtcacctttcgtcctgacatccacattcatttctctgactacccaacccctcacttggatttttcaaaggtatctcaaaattaacacatccaaaatacgtttactctctttctctgcaactcttttcctctccccttatgcatttaaccattcattattttatccaatacgtacttactgatcacttattattttcccatttcaaaagaaatggcagtgttatctccagaggtgtatgacatcagaaactgggaatgatatatgacactttcctcaaattcaactctgcaatcgttcaacttaacactaacccccgtcaattacgtctcctgtatttttctcaggtttgttgtcacattctcactagaactattttagtcaagaccaccatcgcttcttgccaagattacaataataacctcttttgtccattcagatttgcttctctctgaaccattctccacacttcagcgaaagaagtctctgaatcaaagctctaatcatgactctttcctgacaaccacgtgacaaagcccttctgggcagagaaaaaactcccaacaggacccgaaggaccctccaggttctagccccatctcctctttagcttggtctcttgaacatctttcttccaaacataatctgctgtcacattctttctgttcctttatctctgacactctcaggcttagctctttaaatgtggtactctgcatagaaaaatttccaccaccttcacggtagttttgtgtggccaagtctatatcacttcttcacagaagcttttggtgacccagatactaattcaaatttctaactcggacaccagtggttcccctttctctctctctctcaatctctctctctctctctcagaatctcatgagattcatcatggttgattacttgcataaagtctgacatccctgctgggattatgtctgtcatgttcacttctgtatgctcagcatctagttataattaataataataatactaattactgagggagctaaatacttatttgttggatgagtgattgtggtaaaaatgaaaatgaaatgatgtaaaatagtggaatgataaaacagagtgttgaaaatgttgatgagagccagattataaatgctttgagaaatatttcagaggctgtgctgacaggattttggtagagatttgggcaataaagagccagaatggatagggatatatgataactgcagggtttttcagagaaagtgaattataaatccatcagtcaatataagaaatgcagaaagaaaaacaatgttgcggatgttagaaaggattgagagattctgaagtgatgggatgttcaggaaatcgaagttaagatatctagtaggcaagcagaaacctaccttatggccagaacattctctgacccaaaagtctcaagaccattttttttttttttacaactaatgtcaataaactacttttcatgtacactagaaatgatagtgtgaaatatattaatgaggttaactattgttaaaaatcagaatatgcattcctaatatgtgtttgtaaaataaattttattgtatatatttaagggataccacataatggtgtaagatgcatagatatttatatatatagtgtaaaatagttaccattgtggagaacattatcatatctatcatttcacagttacccatttttcactctgtggcaagaacagctataatctattcatttatcaaaaatcttgaatacacactattattaactgtagtcctcatgatgtatattatatcttttaatatattaatatattttaatcatttgtatcctatgacctacattgccccatttcctcacaactaccctgaccctggtaaccactgtttaattcactatctgtatatatttgaccttttttaaaaaaagattccatatataagtgagatcatacaatatttttctttcttggtctggcttatttcatttagcataaggtcctccaggtccatccatgttgggacaaatgacagatcttcttctttttaaggctgaaaaatattccagggggtgtgtgtgtgtgtgtgtgtgtgtgtgtgtgtgtacacacgattcttggaccatatttctttgtaaactgttttctacatattcttagcccttccatagaaaccccagattctctctctctctctctctctctctctctctctctctctctccctctcctcctgctcctcctcctcctgcctacatctctctctcccttcctcttaaagtaactctaaaatataattttaaatattcttattttgtctggtgccagactgttttggacactagccataaaatatttttagctgtgttcatttaagctaccatacaagccaggcgctacatctacagaacacctttctttttactttgtaagttcttttataatattggatgtggtgatgagataaagaaaagagtgaggtataatggtcttcctaggtatcagaattttctttttgagaaactgtttttcttcctttagtaacgaaaacaagagccaacataatgatctgagttctgataatgagtgtgttttggcacaaactgtcacatgaatcaaaggtaacttgaacatgtataaattaacattccacagccagaaaatatttagattcactaaatctgttactctaagcaaaattcaggagttaagtcaatgatagatggccattttggtgtctggatcttaggagaaaataggaccataagaaataaacactgtccttacaaagaaataaacttttgtcctggagttaaatggtaaaaaggacgccccctcaggggagcataccttgataatattgatcatccaaataggatgatatggtttggctgtgtccccatccaaatctcatcttgaattgtagctcccataatccccatgtgtcatgggagtgacctggtgggaggtaattgaatcacggggatggttctgtgctgagggagctaaatacttgtgctgtccttatggcagtgaataagtctcaggagatctgatggttttataaagggcaattttcctgcacacgctcttgcctgccaccatgtaagccatgcctttgctaccccttcaccttccaccatgattgtgaggcctccctagtcatgtgagactgtgagtccattaagcctctttttacttataaattacccagtcttgggtatttcttcatagcagtaggaaaatgaactaatacataggattattgagaaatatacatcaaatataaaatgtgatttttaatgattttttctcgattgatgtctgatggagactaagtgcttaatatgaaaacagaactcatggtgttttcttctgcggaaagcaagttagtgtagtccaggcttgtaacttgctggtataagaaaagatcctagactttccaaagggaaaaatggacagaaggttacatcgtagggtcagcagtttcttagatgtggtcatctggttatagtattactctgaaatattacctccttctaggtttttgataggagtgggattgcagacaatttgaagctctactttatgatgaaagcctggtgagctctaattgagaaatacagacctggtttggatactaaatgagtaggtgtttattaacacactgttaggaaaattgagaattctggcaggttttagtgctcaaagtaaaacctttcccatttacagagagaggtgggcttggagagacccttcagaatgagttgggaccttcctgaagaaggagctctggatccgttcaagcatcactgtgacttctgagagacacgtctctattagtccattttcatactgctataaagaactgcctgagactgggtaatttataaaagaaagaggtttaattgacacacagttcagcatggctggggaggcctcaggaaacttaccatcgtggcataaggtgagaaggagcaagccaccttcttcacaggtggcaggaagaagtgcccagtgaagcaggaagagccccttataaaacaatcagatcttgtgagaactcactcactatcaggagaacagcatgggagaaattgctcccatgattcagttacctccacctggtctctctcccttgacatgtggggattgtggggattacaattcaaaatgagatttgggtggggacacaaagccaaaccataggatccatcaaatcccaggatgatggttctccatccccacaatgtgtgcaatattttaggagtcttttgttactcataatagctaaagtacagatctttgcaagtagtttcatcttccacgagtgaaagcagattcaaacaaaaacattactctcacctgcatcatacgttttcgagagtgagcagtgtgctggaaattgccccaacccatgctgttttatgtaagccatagtccttagaatgtaggtactcagagaagagcaggtacttttttgtgctaggaagaaacatggccaagcaatactgctatctgacgaggaagctgttgttctttaacctggaccattttcagagtaggcattttaaaagctgcctgatgagaactttttgaaactgtagcagagcttccatggatattctgattggatatatcattgcttcctgctcagcttgctaagataacttgaaaacagaaaatccttttgtctggagtaggtatttaattaaccaaatgttaagtattgtgtattttttcagttgcttaagtggaaagacattattacctgaatatagtttttttatgaacaacccagaatattaccgggttaaaggtcattggtttattacttaacctaaaaataattgctttgacatatatggaatattgtatatctcattattttttgataacttcagaagagctaatataatcggaggcagatctacagtggaatagggaattcagaatttatattctaacagaaaaggatacagtaatatgacaaggaaattcctaaaaatatagtatattttccatgtgaaaacatatttccagaccaatttcaaaagaatgatagcttagattcctctctgctgcagtaagctatatcccccacttgaaatacatcccacctttcctataattacctcttccaccagaattgcaattatacatttcttttaatcttttacttttcaaaaataatggaaatttaaattgggaattaagttgcatttaatttccagtttcgcattttaatctttgaaaatagcctagccacaggcaaggtgcagctgaaagcttcaatgacagcacacctaaaatgggaggcctgtcagatttgacatatgaagtggtggtttggcttccagcaaagctttgtccattatgctccctctcttgttcacctctccctctagcttttcttccactgtcagagagctgaaatgcgaataattctactccaggaaacatatttcacataatttctataacaccaaatgaaaagcctttagactatattatcatagaagctagtccttatttaacaccagattttattggatatgtaattttatatacatattgtattacatacctctacctaaatacagaaatactttacagccttattatgtgtaataaaaaaatctaacatcttctcaagccacattgcagatggtagtattatctggatggtgcctcatgaacaaacttcaaaaggaaatgttgatgtgagaagattcctatggttctggtaagactctacatccccctccccccaggtctgtggaataatgtataggcatataaacagtacatacatggcatcaattgttataaccatatatatgtgtgtgcgtgtttaaattgtattaataagatttttttatacactcagcacctaacagtgtctaacacattttatatcttccaataaatgaatgaagcaaatgaaaacatcagtaaacagaaaaaaacaggcattttattcagtttactttaatttgagtggtgtttggttgtaatatctgacaaaagttagtgctatttaatggtttaaaataatttaatgtgtagttttcccctttaagttttgccctgtatcttttgctatggtctgtcagctataatttgttcaatcttttgtgtagctttcttcccagtcttacaagtctaattggggaaagtaagggaattaacaatgatcaaaagtctattctttttctaaacattcacatatctttgaatctctacaggaatcctggaaaagaggatcattttgcagaaaaaaaacataggctagagtttctgaacaccttgtcccaaaggtacagccagagtttgaatccaagtcagtctaattccaaacatagatcttttcctcaaaccataacattttcaagaactgtattttatcatttcttatgatccctgccaacttactcacaatattatcagtagcctagacattcactaaatgccaactgtgaacaagtgaagcctttaagacttggatggtgttgaagttccctggtgtgatatttcagtttactcagtacccacctgaatgaatgctttgaagaaaataaacaagtgaagcttaatcagctaagtaaatgtttggataaaaaaatgaagcttgtttaaataagggaaagcccttattcttctctgatctactcatttaagtcaaacaattaccataaagctaattctcaaaattatgttttctttaattattgaattgggttagtactgtcctttgacccattagtccaaatacacacatgcacagctacacaaatatatatatatatataaatatatatatatatatatgtatgtatacatagagagaatctaaaaaatactctaactgacaagatggagatgacactaatttatgcatatatcagggcaatttcaatttctgcattttaatagcttatctctgatatttgcaaactaagagcttcatttacagactgtacttgtatcatgagttcccaaactacaactacaaatgtttaaatatctttttaaactgagtgtgcatgaatgttttttatcagaagcattatttaaaataattactattatcttttaagtagcatcaggctgttggaatttgctaggaactaccaacaaataccttctcttaaagatactgatcagggaactccaaacattcttgcttctgtatcccctaaaaagactcttgaaaaatgagtcaacccttgcagatttaaaatccgcattcgaaatgtacttttcattcttaaatgactgaaaataatataatttgagggacattgtaaatatcgatatcttaaaactaagatatatgtttatgcctgaaaaaatcttattgatcacctagtatacttttcttaaacagtatgtatacacaatgagtgttttttttctgttactgtaagtcctaaatgtaaaaaacaaaccttttcaattgaggtattgttacaattattaacgtgcaattgaccaaaacaatatatgtatattataaaatttgataaacataaaaataaaattttattgaaaatacatctcttaataagatggatgggtatttaacaatttatacaccttcagaagaatataaattaattctacaattggaaaggcttcagcatcaattctatccctaatttttgtctgtatagatgtaaatgatgaaaaatcttattcaaataggtgagtagaaagaaacggaaggaattgtattatagtagcattgcttaatcatttgtgctcctgctatggcatatgctaaaagtacatgatgattgcttaccaaaacgtatttttaatgatctatcggctgacaacttatcaggtcttctcttcgggttcagttgaaagcaaagagttagcaaccactcttcttgcaaaaagctatgttgccctgtcatgaaagtcattcatgcttcttttgtttgaagccttagtaagatcagagttggatgaaatataaggctttttttcttaaattgggagaagtggttagaaaaggcaagtggttagaaaggagaaacagcctgaggtcttgactacagatgtcttttttttttttttttttttttcaggcaattcagttttcaggaagagtacaaaataaagtagaagatctagaaataaattcccttaaaactatctgtgcctactccttggaatgccttcatgtactcccaggttactccactgtgaggacagctgttttaagaaatttcgaatcattacctgtgacaagaaatataaactggcacatcagaatctcctgataacttgtgtgtccacttcctcagttgtacctcacagctaaatagttatctgttaaaccaagagaagttgcagttctgggggcaatagccttattggtatttgtgcctgaatataattctgaactccctcttttctaccttctaggctttgagttcatttatttcagcagcaaaagatgtcaggagcaagaggcagtcccacatagtgtagattcattgaatgagggagccaaacagtgatttagaaacaacattgccagtaactatctgattagccttaggcaagtttctcaaccttcctgaatctgtttcttcacaataactcccagtctggctgcaccttcgactcacacaaagatctttaaagagatactgttgtccaagcatcgcccccaggaatatggatttgattctctgcttaattctaaagtgaaggcaaaacaggaaaagtcaaagttagaatcattatccatatagtctttcaaaaaatatataataagtgcctatcatgagcagtgttgcaagttttctgtgttaaaatatctacaaattatacttctaaagaaaaattgaatgctacttgaatacaataaatgatacatttgagcttatcagtcttgaaaatcctttgttcaaaaacgatgcaaagtagagagggcaatttagtctacaaaaacttttatttaaaaaaactgaataaatagcacagacacatccaaaaagtgtatagcatggaaaaattcaataatgtatagcacagagacacccccaaatttgtgttgtttatcatgttgcatcatggtcttaattccacatttcatgtagcagaatgtatcccttcattttgagatccagaaggacaaaagggttgcacagttcccctttttctgcctctcggagatcttaaaaatgaatgataaacaattaattctacccaggataccaatgaaaatctattttcttttctttttcccaaacaaaaacctcagaaggcaagtaaactgaccttttaaatgaacaagatctgacatgattgagctaacccaagaaagaaaattcccctctgaagtgaataattttttaattaaaaggtgaaatctgacacatcacactggttttgttattattgttgttttcttccattaatctcacactcgtaagaaaaaaaatgagtgtattatatatgactgtgttttatagatgcatatattctactctatccatttcagtccatcttttcttaatgcatttgtcctgtcacttttactcactgtaattcaattttgttaggaaatgtaactcgctgttttatgctttatatatttcacctgatgcaaaatggactacctgattgattctgcatttttagtccacctttgaatttatagataaagatcaacaattaactttaagcattatgctaaaaaaatcttagccagaaggattgcttcctgaaaatgatttaatttgtatttttcttaaatataataaaatgccctgataagaagtaatcaacaattttgattctagttttccatttgatttgaacatgtacattatttcagcatggtggatgatacatatctacagcttgaaatatgtgcattggggaggttttgttgaatgctagattgctgttttgctgtagtttgatttatttgtgtgagttattagcttgatattggaaagtaactaaaatttgaatatatgatatctctgcttctgaaataaatatagcgattgaaaatggaccttttatgaacgttgagtggggcaatttctggcaggtggggaagagagtaaagaagattcattgtatgaaagcaaagcaaatacacatagaacttgtaatttaacggaacatatcagcagatgtggttctcagaatgactcttacatttacattaatgactatctaaaaagaattagacagcaccgtgaacttcctttttcaaaattaaaagttttttttaaaataaagaagttcagattttagcatcaactgaccaaagcataaggggccatccaagaaaaaaaataatctgaagcactttcataaaacgatgttacaaatcaatattttagacactttgaagatcatctccttgcttttcaaccttcacacttccgagacaggggatatatatgtttatatcatctctttttctaaaataaatcatttctgattgagcatcttttacagaagagcccactgcaaatgtcaatttttataattgcccagaccatacttgtgggaaaaatgaagggacaagagtaggaaggtcattcagggtcactgaatacatttctaccacaggaaagcattacgtcttttgcactttatttcttcaagccattcccttccaacatctcatatccctgtccccccagaaagttggagtcacaggtgacacagctgggaaaactttctttatgaaaagattaacacatgttttaaaaagagatacatatgtatgtcaaaattattccagaacactgttctcagaagggcagtaactgcaaccaagttagtttctgctattgaaacaaaatgtgaagctcatggggaaatttcatcacaatatgctgtctatgaattaaaaatccatttaatataaagcctccaagaaacaaagaaaacttgttttttatttttacagaagacaacgtacaactttttaacccctaacctaattttttaaaccaaaaccagaattattttttttttctttttagctttcaatgaagcacaatcaaattcctggagaaaagatgggaaaacggcataaaacaaagcacgaacacggtatttaaatccaagtttgccacaaaatgtaaatgtatttcagtaaatgttctataggatttgtaaacaattgaaaagctgttatttcttttacaactgcaacataataaacattataataatatacctttctggtaatgatatagaattttttatctggtgacaaatagttctgccaaaagacagataaagtaaatcaaatgcaggcgtaacatctatattatgtagatgtgtgtagttattactagtggagattaatatgatttattatgcttataggtcatttgtttgacctttatagtaaaatgccatttcatatccttcttacatattgttattattaacctccattagtcatatatttttgtaaataccttctctaaatccattatatattttaaaacttggtttatgatttattttgctctatggaagctttaaactatcagttaattcagtctgccaattttatgttttaagtcttccaggcttcctgacttaccaaaaatctgtctcccatgaagcttataaagtcctacactttcctttattgtttatatgaatttatatttctagttagctccttaatctagtagggcgtttttttggtctatagttaaacttataggtacatgaatagtcaattacgagacactatttattaagtgaaataggctatccacacagaactaaaatatccaatcttatttggatgttttcctggactctcacttgtaaaccactaacccatttctctagccttatgccagcacactgtggttttgatcacaattacttcaaagtatagtagaaatctggaagtgtatgttgctgccataatatgcttattaataaaattgtttccaatttatacacacacatacacgcacacaatttccttctatataaactttaaattacatcattgcctatttcctttgaaattatattgcccccaaacacatcaaaagcattctgattataactgtattaaattcaaatgttaacttggctggtattgcaagtttaatgacaataaatcttaaatcctaaaacaatcctacgtagtcaatttttgctttttcttatgtatatttttatgcttttcacctatagggtctacaatttttattcctccttaatttatacattgtcatcagtgtgaatgaaatatttccatttgcatttatagtcattaatatgaataaaagctattatgtatctattcataaagtatttttaaaattatttcacagattttaaaattgagtctcctaggttttctctgcacaataatcctatttaacaataatttttcttctttaaaaatatttcttctttccttttgaggttatcattactattattattttagaggtggaggtcttgctacttttgacttatttcatgagctagaccaagcaaagcaaatttgaaaactttgaaaaataaaaatttgataatttttaacgttgacaatggtgcttctttactagggtgtcagcaaactacaaaaaaaaaaaaaacaactttgttttgcaaactttgtatttataaaattttattgaaagcacaggcacacctactaatttaagtattgtccatagctgcttccaatgccacaactgcagaatcaagtaaatgtgacagagactatttgggccacaaaacttaaaatatttactatctgccccattacagaagaaaaaatgcagatttctctttatccttctccttccttttactacgcagcaggcatacttctaggatttttttttttttcctatataaccacatattatttccgcaaagttattaggaagtacatgggactttccagccccatttcacattggataaaactgaggcatgaataagctaagtcacctgccaaaggtcacgtgggtggcaaatatcttcagcaaaattttgaccccaaaagcctaactatgagttcataactgtgcagtagaaccctttcatctttggtcccatagcacttatcatactgtattgttttgttacattttttttattatactttaagttctagggtacatgtgcacaacatgcaggcttgttacatatgtatacatgtgtaatagactgtagctatatgtaaacataccagctttcttagatgttacttcctcataaagacctccccctagaccagtgattttcaactagggatgattttgctccccaagggacatttggaaatgtctgggacaaatttgtgattaaagaagagagtactattggcatctaatgggcagaggtcagttgtgatgccaaacatcctatagtggacagggcagtccaccacaacaaagatgtatttggctcaaaacgtcagagattgagaaacattgccgtagatcaattgtcatcttctgaactttgacgtttacacatgcaactaattgtacaattatttaacatctgtacacccattcactgctttcaccactagactgaaaaactccatcagagaccacatatgttttgtgcaatgctataccgcctgtgccttccgcaataagtgacacagcagacactcattaagtataagcttagtgagtgaatagtggataacttaaagttttatagtgtatacatgggacttgtcaagagtctctgtgtttcataaacattgtcgtcatattctagctaaccatatttaaaattttatatatatatatatatatatatatatatatatatttcaccacaagatttttatggtggtgcttttatccacagttataagttctttaagagatattttctatcattaaaaaataaatttatgcctatttactgaagtatttgtgaaaaaagcccaactgacgagtaggttagaacattcgaaatcttcaggttttgatagttttgttttacatccgtgttaaagatgttttaactggctcttcaacattctctaagtaggtagggctggctctaggcaagcacctgaagtatagagttagcttcaggtctgccttccttttcttacctttaggatttcctggtatctttatcctatttctcccaatcccatcttctgctctgtacctctcttgttgggaaataagactcagaatcacagactcttagaacacaacaggactttaaggccacctctcctaatcacccaactgataaacaaattcccatgtataactcccaggtcccaatttttcattatcttgcctatgatcaggtatcataagtgctagaaaacacactattaattgaggcaccagttcctgcttttgaaagttctgatatttagatggctttttgttgagtcaaatgtcaccccccactttagcttctatcgagagactgtgtacctcttggaattattcagcacaagtttaaatttttgtgtccgtaacagtccttcaaacatttgaagacaactatcatctctcttcttctccctgctaaacttccctagatctttcattacctagatgacacagcgtcgaggcttctcaatgtatgaacaactaactaacttccaacttttctctgactggtttaaaatctcttgtaagatttgactgtttattcattacatgaaggaacagcgagaataaggggataatggttccctctgttctctcctcaatgcatatttgttgtatactctttgccaggagctatgctaggtcccgggaacacgattttgggcaaaatagacagattcctttccctcttgctgcttataatacaattgtccctcagtatccatgggggattggttccaggatccccacggatagcaaatccacaaatgttcaagtgacatataaaatgacatactatttccatacaacctacacacatcctcctatatactttaaaacatctctagattacttataatacttaatacaatgtaaatgctatataaatacttattacattgtactgtttagggaataatgacaagaaaaacacctataaatcatcagtacagaggtaggcattcattgtttttctgaatatttttgatgcatggttgcattcacagatttgtaatccaagaatatgaagagcccctgtaccaggtaagagggacattgatggaaacattacagttaaaactgaggttacaaatacgacaagtgttgcctgaaactatgagagcatataataagggggcctatatttaaaagtaacatctcacataatcctcacaatgacccaaacatgcattttcaccttaaatatcaggaagcaaaattgcacaggtattcttaacatggatgccgggtctgggcctcaagaagaatccctggttccttcactctatgagggaggtatgatacccaagactcaaagccaagtatgcatagtcttaactcatagttccttctgacaccatgctttctaccacaggctaggattcaaagtcagccataaagatccagaaatgagtaaaacatacatctagttaaggggagaaggcttaattgctctctaggttgccaatatgaaatgaaaaagaatggctaaccacatctctcagcattgtcaaaatagccaatgaacagagagagcactgcaaagacccccaactcaattcagacttcatttctacctatgtggaattgctgcagccagaaatttaagtaaatgttacttaaatgtaagagccatgtacctaactcttaagtggatatcctcaaatgcaaatatccatttaaaatatacaagaattactgtgatataaagtaacaattgctatgtatcttttacttttgtcgcccagtggcctttagactctggatatatgttaactggcatggctactttggaatatttactcatatatgtaaaccataatggccttaaggactacagataaggcttctttcatattaatcaactatctttcaaaatgtgtaccgcaggctgttctcggaatggagctagatttcagccattagcaaaggtctacaaagtaaaatcactgttactgttaacttttatttttctgattaaacatggatatcatttggatatgtgtccccgcccaaatctcatcttgaaatgtaattcccagtgttggaggtggggcctggtgggaggtgactggatcatgtgtgtggatttctcatgaatggtttaacaccatcctcttggtgccatcctcatgatgatgagtgagttctctgagatctggctgtttacacgtgtgtggtacttcattctgtctctcttgctcctgctctagccaggtgaagtgcctgctcccgttctgccttctgccacgactggaagcttcccgaagcctccacagaaggagatgctgctatgcttccggtacagcctgcagaactgtgagccaagtaagtgtcttttctcatccattacccagtctcaggtatttctttatagcaatgcaagaaaagattaatataacacaacacacagacacatgaataaactcataatacactaattaaaacaatattttgaacattaagaaaacatgcccatgtaattttatgaatgtctttcgtatatcctttcagggattggacgttcattctaacatacctcttatatattgtgcattaatttaaaaaataaaggctttatggcttcacctctgcctgtgtattgatggtgcttttagtgtttcacctttgctgttctgctaacatatcctcaataaatcgatcccaagtgccagaaagcaaataaccctttattttttgcacatttagaatgtttcccccaaaaaggagggagacggtaggtattagagagtgcctactgcgtggtgttcaatcacaataggcccttcgattaatatttattcattttgacatcccaacttgttctagtctgtgatggggtctttaacctggcatctgtggatgggattaagggaggtcccaggatcgcaggaattatattacataaggtaaatacctttgcgttgtgagtcaggtgttacattccatttcacagtggaagattattgagatccagcaacatacccacatcattgataattggtagacatggggttgtataccagctctgtgttactctaaaacacatgcttgcttcaacatgccacactgccttcttacagagctgtgaagaagttgaaatcgcgaaagctattaaagatcaaggcagataaacttcatattatgcagccttcttgtgagtataactttcaattatctccaataaccttaactacatacaaaactatcatacatcaatgatggatacagaattaatctcatttgaatcaaatctttaaaagaatttcaactgttgatataattttgaaaacaaacttttttcagttgaggcataatttgcatataataaagtgcaaaagtctaagtgtttggatggatgtgttttgacaattgaatgtatctatgtattcaccacctgaacaaaatagacaacatttccattaccccgaaaaagtcactaatgcctctgtccactcaattccaaccctcacccagaggtaaccactttcttaattctattaccgtaattgagttttgctgtgctttaacttcatgtaaatacccatatttgtgtctatgacttttggctcagcataatatttttgacattcattcattcatatggttgcttttaccattggtttttcctctattcactgccgagtaaaattccattcatggtttaacagaggcatcaactttttgtgaggtagtgagggaaggaggagggaatgactgcatttcatgtgatacgtaaatggaaagaagcacctagctacacaaagagaaaaggaagagcattctgggtctaagaacagagaaacacgtgcaaaggccctgagatgttttagaaagtgaggaagcactaatatgattatcctatatggattgagaaaggttgacttaagaagaaaatggtaaagatagaaatataatatattcattatgtgttgtaattcattgtattctaagccataataaagagttgggtgttcatcctaataagataaatccatgagggccttaagcacagaaatgcctttatctagctgacattttgagaagatccattttgctgcggtgtaggattgaataggaagagaataacaacagtagtaagagaatgtgacctaatctggcaagagggcagaggtgacctggcctaagatgggggagatgcagaggaagagaaggcaaattcaaaataaatttttggagacagaagttgcattgcattacttgcttatagattagatataaaatgggagataaatgatggaatcatgtggactctgcttaccaatcaagtagataagaagaagatactactgtgaaatagatgagggctggggaaggggaaagattttaaataaaatgtcaaagctgcatgtgcggcagccaatgaattgtgtcatatgctcaggtgaacaagcaggtttggaatcaagagaaatatgggatggaaagatagaggagttattcaactaaagatggcagttaagtccgtagaaatggatgctatcacctaggaggagagcgaaaccagaaaccctaggattgaaggtatagtctcaaactgtgacatacctacctccgaggaatttggaacaactcactgggacacaaaagaaaactgtgaatgcttctatttgtgtttgcatttatatttattgatttctattttcacatacgtttacatgcttagtcatattcatatatgatttacaaataaatgtacattttgtgggaagaaatgtgcttataagttttgtttcaattagaaagcagtcttgaaattttgaagagcattgccttagaggtcaagaggcggaggaggagctagcagaaacagctgaaaagaagccagtgagcttcaacagaagttattgtttcaagaagaaagggagtattctgttgttccctctttctatctgtgcagttgtgggaaatgtgaactcatagtttgtctcgtgtggtcctgttccaaatgccatacttgctggaaatagagtgcagagcatccataaaacagtctataagactaagcatatataaggctgccaaagaagtcatttgttactatctatcttcccattcattttctcaagtctagttcttctgctggcctgtggttagggggtttattctgagtatttccctgtgtctttaaaacttcacatttatatttgatggtattccatgaaatcatcaggttacttgtcaggtttcaaatattacatgaactattttggaaaaaaatgtacatttcaggctcatttccagtcctaaacaatataaattatagccaagtatggcatttagccattaatgctgtctttcacttcagtaatgtaaagaaataataggcttatgacaacttggataatacatttaagcttctacattattgctccagatataaaaaaaatttttcacttcacagaggttctaccttgaagaaagaaaaccaggctccagatataagcctgaaactttcctgagtttctgacttttgccagccatttcatcacactaacaacataaaccttaaatagttaaaacaaatgtaaggcatttatgttatatattcaaatggatataccatggaaaaaaagaacctattactgaatatttagtttgcttcaggcttcgcaatcattatagattccacatttaatatatatatgtgctgattgagttgtcttcattatttcttataaaatatctccaatgttcaatctattgatcatgttgaaagaaaaagggtttagatgagctgtacacatacatatatactctcgggatcatgataaaacaagacaggtggcctggcacggtggctcacgcctgtaatcccagcactttgggaggccaaggtgggcagatcacgaggtcaggagatcgagaccatcctggctaacacggtgaaaccccgtctctactaaaaatacaaaaaaattagcggggcgtggtagccagcgcctgtagtaccagctactcgggaggctgaggcaggagaatggcgtaaacccgggaggcagagcttgcagtgagccaagatcgcgccactgtactccagcctggggtgacagagcgagactccatctcaaaaaaaaaaaaaaaaaaacaaaaacaaaagaaaaaacaagacaggtgactttgaattttaatgaacaagttagaaccctcccccaacatctggttttaaatgctattactttcggtatgtattgcttatcttaataagtatgatgagcttaaatattagcttatcttcgggtccctctcttttttattttaatttttgtgggtacatcgtaggagtatatatttgtagggtacatgagatgttttgacacaggcaggcaatgggtaataatcacatcatggagaacggggtatccatcccttcaagcatttctcctttgtgttacaaacaatccaatcacactcctttagttatttttaaatgtacaagtaactcattattaaccataatcatcccgttgtttgatcagatcaaatagtgtgtcttattttccctgtagaattatttggaaattttctgtttatgttttcatgagctttgggatttggggaagaatttcagcatttttgacttaagatatagttggttcacttagcccagcagtgaacttcagggggtcaatagcatgcaaatatgtatttaaatattaaacatttttgtttctgttaacatcaaaaatttattggacatttaatcttttaacagaaaatatctcatggtttcatatgaaaagtggatgttcttcacattttatttatttcaaataatttacatttatttttacttattggaattggaaaatataagttgtatatatcacgtattatacaacacattgtattgaaaaatgtggactagctaaaatgagctaattaacatatgcattacctcacatactatttttttgcggtgagaacacttaaaatcgactctcttagtaattttcgaaaacatattattattaattatagtcactatgtcgtacaaaagatctcatgaacttatgtctcctatctaactgaaattttgtatcctctgaccaacacagcccttttgtatcctttgattttaaaaaaggcgttgtttaattttaacagtgtcaagacttttaatgataccaggtcctgaaaatgtcagactgtgtttcccatacagtttctttagcatgaaaggggatgtatgcatttgaaatatagtagttgatgaacatcttttagatttttcagtagaattaaaactggatgataaaaattcagcacatatcaactatattccaaaaatcaataaaagtgcctaggagaaacatttaaaaggttaaggaaattaagaaaatggataagataataagataatttaagaaaaattatccaaaacttagaagtaaaacaaaagatgatcgtgtgtgtttcaaaataatggtagcgttgttttctaacaaactcctcacaccctcacaagagcttcaatattttcagagtaaagcaactcttactgtttactattaatttgggcccacacatgttacaacgctatgaagttcaatgcaaattttagaaaactgatatgatgtaaatgactttttacccagtagaggatataaccccaaaggctgtagggtatcaacgagtttagtatcttattcactaatcttattccagaatacttttttaaaaattcactcattatagaagcatttgtttcttgtattctcttttgaaccagttttgtcttcctaccagctctccaattactgtattaaataaaacctaccgtgagttcactatgatttacatgaaaattatgtttcttcataaaatttcactgtgctgataggtggtagaattatgaattttctttgtacttttctccattattcaaaatgtccccagtatactctgaacaaaattaaacatttaattggaaaaaatacatgctatatgcaaatctatttagcttcgtgttgccttaggtatgcaagacgttacatatcatacaaaaaaaatctaagccaccaaagataaaacagttttgcaatcaatagtgtttttccttttctcttccatcagcagcacagcgatgtacaataaggaaataaagtaaactttagaaatatgaaatgtgtatacgtattgacgtgcttattgtgaatgcgatgagaaaggcaagtcaggacagtgagagtcaggttcattacactgcattctcacactataaatgaaagagtagcaagtattggctaaaattcaataacttccatggccaagatacctactataatttgaacattgattccctttgagaagctttctcctgaggcaccatcaagacagatattaataattagtagttcagctaggggttggaccacaaatatcaacctgaacaaactacagaacaccctccacatttgcttcagcactgacagttttgaacactccctggtggccaaactcacttgttttcacctttgaaatgagttagttttcactgagtgctgttgggtactgagccactagcagaagtgaggatgtgcagtctgatgactcacggttgcacgccactaaatactgccaattacacacatttttccccttgcaaattttggggaagggggaggggtgtgaagggggaggggtgtgaaggaggaggggtgtgagcagctgcatataaggagtgcctatactttctttcttttcttttttttttgagacagtcttactctgtcacccaggtcggagtgcagtggtgctatctcagctcactgcaacctctgtctcccaggttcaagcaatcttcccgcctcagcctcctgagtagctgggactatcagcaagcgccaccacgcaaggcttttgtgtgtgtgtgtgtgtgtgtgtgtgtgtgtgtgtgtgtgtgtgtgtatttttagtagaggtggagtttcaccctgtaggccaggctagactcaaacttctgggctcaagcaatactctcgccccagcttcccaaagtgctgggattacaggcttgaaccaccatgcttggccaggagcacctatagtttctacctcaaaaacatagccccctatacctttccacagattatattgttacttttgatattgaacttcttttcattgtaaaagcctggagaaaatttaaggctgtttatatatctgttttctaaatcagcacaccaactgtgaactctgcacttttgaattgggatgagagaatggaaagaaaaaaggttgggagaggagcggagctgggaagaaaggtgatctctagtcctttttcctccgctccctgctccagctcacttttccaatcagtttttataataagcattatttattctcctacaaaagtctcaaagtttactagttataaaaaactcatgatgctttattaaatagggtaaatttgactttgtaaagcaaaaataacaaaatacgtaatttgtaattttcaaaatatacacatgtaatttgaaattacatgtaatttcatattatgcatgtgtgtaatgcaagcacacatgtaacaatacatatgtaacgtgttatatatgtaacacgttacatatgtgttgcatacatatgcacgtgttaggtaacgtgttttacatgtcacatgtaacaatcaatttcacatgtaacatcagttacatatgtgaaaacacacatatgtaatcacacacatatataatttgaaatttttcatagccacatttttaaaagcaaaatgaagtcaatttaattatatattttatttaatcaactataataaaaccataattttaacatgcaataaatgagcatttacttcctttttggttctaagtattcaaaccctggcatgtgtgttatactcagtgcccatctcaattagtactagccgcattttaagagctcagtatcttatgtggctagggggcactgaattggactttgcagctctaaagagagacctcacattgtgatttttattgtcaggcaaatttcaaaattatttctctgcttggatgaggcaccacgtctcactccttgcaaatacatcactctcactaccaaatcctggattagttcagtgttgatgtcatattgttatgagctcacaacacctgtagcattcacacaaataggatacagtggtttaccccttatctgtaggggatacattccaagactcccagtggatgtctgaaactgcagatagtactgagccctatataaactatatgtacttgtgataaattttaatttataaatttggcgcagttaagagattaaaaatcatgaataaaaatagaacaattataacaatacattgtaatgaaaatcatgtgaatgtgatctttctttctctctcttaaaatatcttattgtattgtagtcacctattttcagacagcagttgaccatgggtcactgaaactggggaaagcaaaactgtggatattttgttccaccactgtggagatgtacattatgactacatcattaccaccatctgtggttttcctttaagggtgagactatttatatgcaaattcaaacaccccccccccccccaacaaggaggccatatttagattacctcctggaaagttacttaactctctggaatttgaatttaaataaagagtagacttcttatttcattttgggttttgagaactatatcaagagctcaatatcctgtgaatgaaatactgatcatgcaaacacagccaaagattgtctagggaaaatgctgaagggaactttccaaatccactatagttcttctttcttaccattccatttatgggctgtccacttactccctggcatctgtcctgtgcccctttctgattgtaagtacagtcaacaatgatacaggcaaagtcattcgcttatctgtttctttaagactccagtgcaatgatacaattagacttccaaattctcataagtcaaaaggtacaaatccctgaaaactgctgaatgagtattgaagtgttggcagttacagcttatgatagaatttttattttcaaaagagaaatttaattcagggatatcactatacgtatatccttttatttcctttttgggaactctataagaagccatacttgtttcattgctggatctcttatttcctggaataatacttgtcacacagtaggtcaacaaatatttggttaatttatgtattgagagaattgcttggcacaattcaaccctctcaaagtttatgcaggtgagcaccgtgcagtatagtctcctttggcagcaagagcttaatatctgattttgagagagctgagaatgatacgcaaaacagcattagtttcttccctatatttttaattacagtaatgctgtcttttaaaataagactcctgagtactttatgatcataataaatccatcttaatcgcattcactgctttattttcttttttatttcttttgagacagagtctcactctgtcgccaggctggagtgcagtggcacgatcttggctcactgcgacctccgcctctcgggttcaagcgatactcctgcctcagcctcccaagtagctgggactctaggcatgcaccaccacgcctggctaattttcatatttttagtagagatggggtttcgccatgttggccaggatggtctcgatttcttgacctagtgatctgcctgcctcggcctcccaaagtgctgggattacaggcgtgagccaccgcacccagcccactgctttattttcaagcagaaaacatacacaacaccttcagatggatgctaaagtagaaataaactgtttaaaaatgattgtcatgtggtatgtctgagaagaaaataagcatcacaggatcacaaaatctgttaaatatctgtctccaatcatgacttgaagttgcactctttcaagtatgctaaactgcagttttcctttaaagttcaaaccgtaattataatgtaaaaacccaggaagtatacagcaaaccgtaagtatcctaaacaaacttaaatcttgaaaagtgcaaatctcatccccaaaagcctttgctcaaacacattctgcaactgtggtttataggctaaaacacagacttgtctgtgtaccgtgtaatgtcctttgcaaagttttcctaacctacctgtctggcccatgctatcaccctccatctggaggcctgggatcccaaagcttttgccacttaatattggttgccattctccaagctggcttttccagactgaggtcatctcttctgtttctataaaacttttaaaatacagttattatggaaatttaaaactattatgctatatcataactttgaggtttatgtatctatctctccctgcactagactggctttcttgagtgctggaaatatgattgattccttattccctcacataaaggcaggcatctgcctccctgactgaggtagggtcactgcacaagtagtattgttttcctcaatgttgaaacttttggtctgcagcactgtcctgaaacttaagaaaactatgttgaatgagccaaagaaggctgatattcagggaacagtaaattttaaggaaaagcagttttgcctgtagggaaccatgtcttatggtgggcttttctcttgagggtattctgaaagggaggcaattactaaatccttggctatgatcttcaaagggcttctgccctgtggaaaccaagaggctttcttagagaccatcagcccttgccatacacaatccaatgctcatgtcctccatttgacagccgcttgctaaattcctccgtcacctcagtaacctatgtcttagagtgatatagaatccgccaaatctatatatcaaacagagattaccatgagagtaacaatgtaattgaaggcacttcttaaattatgaagtgctttgttatgttatgactactgttattatcatcaacaaccctaacatcatctctaataacaactccttttaacatccttcttttaatacactatgggtcaaattataattatattaataaatatgttatgtctcaactttactgatgacaatataaaataagtttaattagagctctactcataactaaataacatttttatgaataaaagaagtttcatcttcatcacttaatatatttaaggtctcttaggaagaccttgtcctgtagtcagtggtattattctttttattagtttcctcaagatttattaggcagagcagtgacttaatgtttttggcttaacatttctaacttctagctgatgaacagtaaaaaaaatatggtgtttgaatcccagattcttcatttattagctttatgatttgggataaagcgtttaaactttccgaaatttttgtctaagagttataagaataccttttctacctatcttgctgggagtatttcaaaatcacatgaagtcatattcttggtaatttttaaaacagcatgcaaaagcaaggcactaaaccaactttataaattactgcaatgaaataaatcttgtattacatctttctgtgtatattcttgtaaagttgattttgtactattttccaaaagtattagttttctgaactggcttcttaattttctaaaacttatacttccttacactcaccatattacaaccttgtgacactcaaccagaaatcacccaacacacacatacacatacaactgtgttagtcccttcttgcattgctataaagaaatacctgaaactgggtgctttaaaaagaaaaggggttttcttttgacttacggttctgcaggctgtacaggaagcatgtcactggcatctacttctggtgagagcctcaggaagtttacaaccaaccatggtggaaggcaaaggggagagcaggaaacaggtgggggttgaggtctcatactcttttaaacaaccacatatagcatgaactaacttgtcaccaaagggatcattcatgaaggatccacccacatgatccaatcacacctaccaggccctgcctccaacattggaaatcacatttcaatataagattcggaggtgataaacatccaagccatctctctctctctctctctctctctctctcacatacacacacacacacacacacacacacacacacccacacacacacagtcgcaattaaaacaaaaaatctgtgaaacatctatttgtgatgaatgctgatattttctattttgtttcactaaaaatcaaaggccggtgttgatccacaaactgagtttatgattcacagtttggacaatgaacactagcatactagatttaaaaaatgaaattaaccaaaacaaaaccaacaataaaataaaaaatgtcctcagcattattttgtgccatttctttccatgcatccaacacgcttaccaagagttcctctcatcttgtcattatcataccacaagtttttctgacaccatcacttttcaactttttctcattttcatggatttacaattctctcccttattttcatatcgctctctctatgaagctttcccaattcttctggctagttactctttgggttgcctctgctctgactcatcaatggtgtaccgacctctattatatctattagatgctatttttatggcttaaatgtccatttgctaattataccacttaaatgtttcaattgtttaaatgtccatcaatttcagcaaaccttggattatatgtgaataggttaggattgtatcaatttcaatatcctgagcacctagcatagagcctgacacagagcagctccaaaagtaaaagttttctgaataaatgtgttgatgttaaaggttaggtgaaatgtagagaagtgtcaaagtacacaagatgttcaggttttctaagataaaggtaatctccctggtgtgattctgtcctgcacagctgttctcttgagcagtggtcctttatcatcatctgccttctctcccacctaagtgcgtcctgccacctgatggacgatgatggacatgagtcctctgaggccccaaaactatctttttggttgtgaactaaaggccgacaaagatgatcactttaaggtggataataatgaaattgagcaacagttatctttaagaacggtcagtttaggggctggggcaaaggataaattgcacattgttgaagcagaggcaatgagttacaaaggcagtccaattaaagtaacactggcagctttgaaaatgtctgtacagcccatggtttcccttgagggctttgaaataacaccatcagtggtcttacggttgaagtgtggttcagggccagtgcatgtgagtggacagcatttagtagctggggaggaagatacagagtcagaagacgaacaggaggaggatgtgaaactcataagtatatctggaaagcgatctgctcctggaggtggtagcaaggttccacagaaaaaagtaaaacttgctgctgatgaagatgatgattttgatgatgatgatgattttgatgatgaggaaactgaagaaaaagcgccagtgaagaaatctatatgagatactccagccaaaaatgcacaaaagtcaaatcggaatggaaaagactcaaaaccgtcaacaccaagatcaaaaggacaagaatccttcaaaacaaggaaaaactcctaaaacacccaaaggacctagttctgtagaagacattaaagcaaaaatgcaagcaagtatagaaaaaggtggttctcttcctaaagtggaagccaagttcatgaattatgtgaagaattgcttccagatgactgaccagaggctattcaagatctctggcagtggaggaagtctctctaagaaaatagtttaaacaatttgttaaaaattttccatctgatttcgtttctgtaacagttgatatctggctgtcgttttgataatgcagagtgagaaccttccctaccatgtttgataaatgttgtccagattccattgccaagaatgtgttgtccaaaatgcctgtttagtttttaaagatggaactccaccctttgcttggttttaaggatgtatggaatgttatgctaggacatagtagtagcagtggtcagacatggaaatggtgggtagacaaaagtatacatgtaaaataaaagtattttaataaagtaaaaaaaatgataaaggtaatcacattagaagattcatctcttgggtgcaacagctagggtagcctcccaagccctgtgtggtagtagtcagtatcactactatggtttcaatgtttttccctccaaaactgatgttgaaatttaattgccattgtgacagtattaaggggtgggagctttaggaggtgattaaggattgagggctccaccctcacgagtgggtttggttcccttataaaagtgggagttcagcccccttttgatctttcttgccctctaatcgtccatcatgtgatgacatatcaagtaggccctcgccagaggctgacaccttaatgttagacttcctagtctccagaactgtgagccaatacatttttgttcattacaaattattacctagtcttaggtactttgttacagcagcacaaaacgtattaagagagttacctacttatcttttctgaacatcattacaattccatttcaaaatttctgctcttaatgatatcccaaggagactagaaaatatttcaacagttcagccactcttcaatgaaattatcttgcgtggtcatgtactcgttaaattgccctgaccattctttgaaggatagcactggttatgagattaaatttgaaagttcctatgaactatcagttgagtgaatttgcttattatagcatatatcttaatcatatgttcataagcctccattaagccaggctgcacagtttatttttttaacaattgcattgttttaaagttacagttgtttcagcaatccattactagtatttaaaagtacacacattgtccttttgtaaatacatacaacagccataaattataaaaaaatagaaattcaaggataaaatgtttgaaaaatgtgttatttaagattagcagtaaaattggattttcaaataaatccatgttaactaggatttacaatacaagcctgtactatgagttgtaaagccaggattttgagaactatgctgccacattaaatttattcattttcacagcctgcagacattttaatgcctgagtagcaataagaacaaattaccaaaaaaacttttaatagggtataataaattaagactgaatggtaatgcaaacgtgggtacaacaggacaaaattatgaatctcatataatgacccaacaacacttagagtgtggaaacaacgttggtattctgggatatacgaccacggttaatcctaattgtttttcccttgtcaaatagaaattgcacatcaatctcaaagtattacaaactgttcattacatgcaaatggttatgttctgcaggctctccaaggggactcaaccttctttacaaaaggagccaggctagaagcagagtttctctaatgacagtaagtatccattagagttcctcatatataagcaagagagactgcctctgattcccaaagtcaggttttcccaagtcagactaggtatcccagaggtgtaatggaggactgtcaattagggggcaggaaaaataacagctggaaaaacaacccaccatttgtcctaggccagatccagtactttctggagtgtttacttactgccctttgctttagacgttgtgccttaagacgttgaactcatgagactgtgagctcataaagagaaaaggagctcttagtcagctctgtattcctagcagcaagcagtatctgctttgcacacagtaggatcacaatatatgtttgttacatgggttctggtatttaacatatgctccaatgggtaagagaacagggccatcatattgttaaagtatcaggcaatgtgaaaattttaagtgctctgtacacagaagaggtgaaggaagctcaatgtaagagagaatgttttggctatgaaaagcaaggacaaacttggggatcatttgtctcaggtaatacaataaaagtatcatttttaaatttatttatgtatttattcgttctactgaatattacattttcaatatatgaatcaatttttctacgtaccgaggtatattggtgatcgagaaagaccaagtacccaaaatatgttcattctaatggaaaagataataaacatgaaaacacatactacagtttcagcaagtgacagagttatgaagaaagttaagcagatctcccagaaagagttcaattttgtgtgtgtgcatgtgtgcgtacgtgtgtgctttctttaagatgggggagttacaaaaggcatatctgtgaatataaaattagagcacaaatatatataaagggaagtgtacaaaaattctgagagggagtagattgggacatggtgagaaactggagatagggtagagccctctggtagagagaaaagcaaatttaaaggtagaaacaagcattctagggaacagtaagaagggatgtgaaaagaaaacacgaagatcaatatggctggaacatcgtccttgcaaaatattatttcatgaaaattacttctattaactttaatcttacatttcattaaatgacaatttctgcttctcattgcttccagaatgatggtgcgcagttttgttttgattttttctatttggaatttgcaatcagcattcttctcattttttgtagtctcttactctcttgataatttcatgctctaagaatgggaatcccttagggatgacatgtttatcctgcattttaagcagttctttaccgtggttactacagtaagttatgtttttttgttcttgcttctttccaataatgtatgaaaatctgtcatcttcttaaacatgccatgctggacaacggaagtctaataacaagccactgaaattatccaattattttaatatacttatttctgaaagatacacttgatgggcaaggattgaaagcccctctcggaatttctgcctggtaccacactcccagtaaattggttatttactacttctgaaaagatggataggggccaaaaagttgcagaggagtttccaagcagcaataaaagggtaacaatatttacgcaaggatgaagtgcccaactgtttaactgtattaagagacttaactctcatgccactaccagctaataactttgaaaagctcattttaaaatgtattcccacacttacacattgctgtaaccttaaagtaagtgactagagacaaattctcttagcagtaaattttccggctgattcccttatgctagtgtatgtcttctagttacagaaaccaggatagctttgtgaccacaaaacaaaatcttatgaaattttattactgctggggaaatataaaggacaagcaatggtatgaattattcttaacgttagggtcccagtgaagggcaacagatggtagaaatatttactccagtgatttttccatcaaagtttctatcagcatttgaatctcagcagtgtggctgttaagaagccgtcaaactcagcagccagctggtgaaatcacaatgtaaaaactgactatacagaaaatatacttgtgtctgatttttttacatcatatgcctttttctagattatcctttaattcaatctgtattaatataaattcacttacctcctatagagttctttgaggcagtagattgccatgttaggtgtatcctaataaaaatacgaaaactcattctctgtagcagatactgtcagtgacctatgcacatctattcagcactcatcatttttgtacaagtcaatgacctttcaacggcagtacctgttagataagggctttctgggctgcgagtgctgaaagcaaggcgagaagaatgagaaaacctgggtatttccattaagaggaggacggtcttttcatggactcgcttgtctcaaacttttgagcaggagtcactccaactccattgtgctctctgaatctaaactcttcagaattgggtcctttaaaaagtgctttagaattttcttcaatcactaataaccatggtaaggtaaagctgaagagcagctaaagggagagctgaagagcagctaaacttggctttgacatttttgtactctttttttgccttctctcaactccaaagcaccagtgtgctctttctttctcccttttgttcctcatctgagagatcacagcagggtcaccatgctataactacatgctttatatgtaattttccattctctctggacatttcacatttgagaaaagggagtgtatttttcttcaatagaatatgacgttaaactataagtttttcaacatttgatggtgggaccatgtgaacattaaaatatgacatatgtaatccatatttacttctgtatgctcaatgacaatgaataaatttttactttcatatcacaaagtaaacagttttttattacatttctttacagcaacatatataaatatattgcacatttaccatataacataggttatggagcagtaaaacacactaacattgcaaaagataccagaaaaccaattagcttaaccttaacaagactatattttttccctaaaaacagcagtttattcatgtcagaataacacactggtgtttcgctccccatgtctgcttaacatttgttgatttaaagcctaaaaaatttcatctaaacaataccactactgttaatgtcttaaggtcgatttcaaatggaataccttaagattttagggtctcaggcttgtatgtctgcgacaacgttctgcaggaaatactggtcatttttaatatggttcattcagcagcattatttcataaaacagatgccatttccattaataaaaatattcagctggtttaaatacttaatctaatggtaattgttattgtttctactggcaactacaaacattttccatctcattctatcatagcccatgttttaaaacttattttttcctagtctccaagaacatgctagctttaaatgttagggcattttataatttctactttcctattttcactgaagggacttgaaagcacacaaattcaccctgtcaatatatgagctaacattatttgtgtcactttccttcatggtgttcagcttttcctttgaaaactcccattaacatttcttcttgttagctaggaaatgagtaggcagaagtgtcagctatctgaaacagatgcgtttggctgaattggaattttcctcaattcctaatccaagagcccttatgctttgagaagaaattatactacataaaaataaggttttatgaaatttccaggttggtttttctgcagtgtggatgtttagagacgataattcagtaaataagtcttagtttgtattgatatgaactaatcacttataaagagtgattagttataataggggcttacatttaatgagtaattattttgtgcaaaatgctattccaagtggctttatacacatctcatttatatttccattttagagaagagaaatcagagacatgaaaagaattaagatattttcacaagattctacaactattaagctaaaggacctgggatttgaatccaatctttctgagtccagcatttaaccacttaaccccctttctaaacttctattagagcctcatgtggattgtcactgttttggtggatgataaaactttgtatatgcactcaattactgcttgtttagtgaatgcattaagagatgctgatatcattcaacgaatttaataaaccaatttgagtggcatataacatgatcaatatttttctcaggtaaaaaaatgggatatttttagagaggttctccatagtggcatggtatattgctctggaatatcttcaaaaagcactaattcatgtacttaattttgtcttttacttgcgacagaggaaaaaaaatagagttgcatggaaccagattatctttctactgctattggcagtcagtatattttgaatgataacactaagtctcagttaaagcactaaattctcttctttaaagtgaaaaaaatatgatgcaatttgatcaaaatacatagggacaagtttacaacatatatctatttgtttatttcatatctaaaagttatttctttactgaaaattgtacatatgaggcttcagactccaacgtgcttctgcgtgtgtttgtttaatatatgggctgcttggttgatttttttcacagtaaccattactggctcatgccaaacaattgcctgctaacagccactgtctacatcctgtcttctaaaataatttcatagtaaatattgaaactcattctcttattcattattagtcaatcaacaaaggccaagatagcagaaattaccaaagctttgatttgccttatcgatgaaggtatcttacggggttgattttacccattttacgataattactcagaatggaaagataacctaaggtacattatgtgcgtgtatatgtattcatgtgtgtgtgcacgctcatgtgtgtgcacatgttcatatgcatgattttggacataaaataaccaggaaagaaataccttaactgtttggggggtttgtgatatcattcacagctcttttctgaaagaatttttccttggacatctagaatgatttttcttatctcatctatagattgagaaaaaatagactaaataaaatggtctttttaaaattatccagttggccaggcatggtggctcacgtctgcaatcccagcactttgggaggctgagacaggcagaccacctgaggtcggagatctagaccagcctgaccaacatggtgaaatctcgtctctactaaaaatacaaaaattagccaggtgtgggggtgggcacctgtaatcccagctactcgggaggctaaggcaggagaattgcttgaagcctggaggcagaggttgcagtgagctgagatcatgccactccagcctgggtgacaaaagcaaaattccatctcaaaaaaaaaaaagtatccaattgaggggaaaagttttgataaaatgttcatcagtttcaactaaaccacactgtcaagaaatgaggaccattagacattctctgaaaattttaaattatgatatattcacaaaattgtgtaatgttaatgtattaaaagatcaaattacatcaaaatagtttgttttggacttgttttcaagttggagtaaaggaggctgaacttaatctcctgcctgaaacacctgaaacacttaaaaaaaaaaaaaaaaaaaaaaagacaaaatatatgctacaacggttttcaacacattgaacatcagacattgaaggacagtgatccttgccaggaggcttttgttaaaagatgaagctgagagtttcagcagcccaaggctgactagtgatcacagggcaaaataccagagaggtgatatatacacagaggaaattttggagatttgtagaaagctttattttattcttcatctgagtcttgatcagttcatgtatgcaagaaaaccactcaaagctaaggaaagaacttcacaaaagaattaaaggaaacaatcaccagagctcacacgtggctagtaataccacctgttcccacgagccccagtgaaaaattttatcattcacaggacatcagagagagtactcagaagggttttgcctcagtagtggggaaaaagtagccctaaacttacactgttctggtcataacaaagcataaaaggaagattctcaaaagatcaaattgtttccaagtgaattaactgtgttccagaacgaggtttgagaatatttatttcaatatatttgaatttatttgaagtatcaagcacgcgctaagttaaaattcacaatgtctggcatatagtcaaaaattaccagtcatccaaagaagcagttaaacaacacacttaatgaggagaaaaataaatcaatttaaattaacccagaatagacacagatgataaaattagtagagaagaatattctaacagttattatatctgtattccatatagtcaagaaagtaaagactgaacatgttgagtagacacatggaagaaataaaaagacccaacttttacttctaagagatgaaaatgtctgatgttaaaaatatatactacatgggattagccatagattagactttgaaaaagattagtcaatttgacaatagagattatataaaacaaattacagagaaaagagagaccaaacagacaatgaacataacatcagtgagtagtggggcactttaaggagcctaataaatgtacaattggagttccattttttttaaaaaaatggttgaaaggtttctaaatttgatgaaatgttaaatgcacagattcaagagcttaactgacttcaagaacaagaaacatgaagaaaactacaccaagttacatcaaaacaaattgcttcatcgtaaaagtactccctagttaaccttctacatacaaatctccattttacaatggctttccaagaaacccagcctgaaatatgtagcaaaattcatactgaacaactatcctccaaagagtagaatggaggtacttttacaaatttctatgttacttgatttttttcacaataagtactaatttgataataaaatataaattgaaatatataactaccttgggttggatatcattgaaaatggcaagtggtttctatatctaccccaaaacattttatataactctaatatgtttctgcctctcaggcagaaaccccattatgctacattagcccaaaattcacttcagtgctatttttaaaatgtatcttctatattaaagcagattgggaatccatacatttcctctctatacaaatgccaacgctggtgtgcatgcaagtttgattgatacacatataattacacaaggttttaaaaatattttctgtgtttaaatagcttatcatataaataggtgtttaaatgcttaactccttaatattaaagggcatatttactatggaaacatatttgagaatgaagacttgtaaagtcaaatgtgatactgcttttgtgaatccagcattttgaaatatctaaagtatttaataaactactgggtgttttttgccctcatctgtcttaatcagtattttctggcattaaaaattggctacaattcaaatccacttgattgactattgcaacatgaacaatttgagctaaaaaagatgcaaaaataattaagtcttcgtgtaataaacacagtgtttcttatgcctaaactatgtaatttagcaaccaaattatatcctggacaatctaatctatctttacctgcatattcaaaggacaccacaagttgaaattaaactacacactggttatcatccatatgctgtttccctattaacataaaccataaaatgtcaataagtaccaacaattaactctgcattgttttggcctctggactatttcagaaggcattttgtcaatagaatatatagaaatattgctacagcactacaaaattgtctttaggaaaacagaactgtaattttatcatgatggatatttctagcaacttcattttagctaagtatgccacaagttctccttctggaaaggttccaacataaagccgaaatacacactgccccaaagccacaaaacaccttgctgttacgatgcttccctctgtcacagattcaattatattttgcagtttatcagataaaccagctccgtccaggcaaactctctcatcctgacacaaaaagtccatagcaccgtgctctaatattatcattatgataattttctttctagtaatataatgatgacaacaacagtcaaaagtaatttccatcacccttcagaacctgatctttaagaagttaaagagtccagatgtgctgaagataaatacaatttcgaaaaaacaaatcaaagacttaccttaagataccatttgtatttagcatgttcccaattctcaggaatttgtgtctttctgagaaactgttcagcttctgttagccactgattaaatatctttatatcataatgaaaacgccgccatttctcaacagatctgtcaaatcgcctgcaggtaaaagcatatggatcaagaaaaatagatggattatgtaaaacagattatagagatatagcgtatattttttggttatactgacaaagatatcactctgatagtttcctgcatttgcagagtttagtttcaagtaacaaataaaaattaatatacacacctagcatgtacacacaacattttaaaaaaatactcaatataaaagctgattttaaatggaaggttgcaatttttccctttaaaatgaatatatttattgattaaaagaaagataaagcaactattttggactattggcattttctttcctaaaaatatatttttttaattctagaaatttacaaatatcttaacattgtaataaattatttggaagcaatatattccctttcaaaatatttttggataaaaattacttcataaattctatcactttcaatattattcttgatccaaaactgcctgttcatcaactgaaaggagtaataagttctagtgttctattgcatagtaatatgaacaaagttaccaatattgtgctgtatatttcaaaatagtgaaagagaattttaaattttctcaccacagagaaattataaatgtttgaggctatggatctgccaagaaacctgatttgatcattacacaatgaaacattacactgaaacgtcacactgtaccccataaatacatatagttattacaaataaaactttaaaaatataactaaaataccattatcacaccaataaatcaataattcgtcactatcattaaagattctgtcaatatttaaaataagatgacagatataattcatattgtaggctcacatgtaagcattaaataaccgatatactaaactatgcgatgccttctttaatccttcttattttattgtagtcactaaaattttagattggaatactgcaggaacttagtacaagtcaaatgtgttaatactacacatggaaagaatattaggaaacaagcatttggtcaccttccagtcataaaagagactgaggcagaaataatatgaaccagggctgtatgtttacctaagacagttgcacataagaatcaactggggcatttaaaacacagcaacaacaataaccaaacagtgatcctggggctccattccagaccaacttaatcagtatttctggaggttggacactgacgctgttatttttcaaagcatccaggtgatttcaatgtacagtcaaggtgaaaaacactgccgtaaagtaagatttgaaatcttactgggcttacagtctaccagatttcctggggcctgcccaagcaagcatttgtgagcacaaaaccaatagccatcctacagattaccggctatggtgctgcctcagagtacaggaatctgtcaagcttttctgaactctattcttaagaagcaatggatcatacttttgaataccatgatatcttttcagtcctctaccttcattcaggaatttaaagtaacactagaagttttaaattgctacatctgcctactgatgtcctgggcagagaaaggaattaacatttattaaacagttactaatagccaggcaccgggctctgtgcttttatagtgccagacacatcatttcattgacacctacaataaccctgcagcataacaattattattcccattttccattggagaaaacagaggccaagtaatttgccaaaaggtgaaaatggtattaaatagtagagagaggcttctaacccaaatatctcttgtttcaatggcacttttctaccagtgcacatgctctcttgtgaaattatttttccaagatgaagcttcactttatcagttaaacaattaaaagtgatagttctagaggttttttccccttatttttattaactacccaaaatttaataatgtatctacatgtacattgcactcattgtatttaatgaataattatatgcttaacctttaaaatcttgtaaaacagacagcattttggtagcataaaaaaggcaaccgaaggtagccgaagaggtattctctaactgtagttagtgaaaaataagaatgttgcctttgatgatttatggtattctagagttattcagatacaatatatccttccacaacaaaatgatcttgccaatgtttttgcatgtttactaataatttagcattcatatattttcaatggtatataacacacaataaatgacctatgaatatatcgtaagtttattccctttaaaaatgaattgcacattgcatatgttacatgcatttgcatcactggagtcaaagagttgcttttgaatgagaatctaaaaatctatgcaacatagttagcattgttccatactggtgagactatattttcttatataatttttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgtttttcctacccaatcacttgaactatacttttgccaacacttttagctactaggaggtgactgtttctctgacatactgctataaatgcccattcttcatttcaggatcctgtacacctcaaagattttcgatttcaaacctgttgcacagacttgtttctcaatcactcatcatattggtaattgccatcctctatcaaattcaacaaatccccctctcaccctgaattcttttcctttttacaagttatctacaagtttctacaagttatctttcctttacattctcccaagagaagaaaaccgtaagggttcatacacttgctcatggtatccgtagctctgtaagacagagctggaggtaggaagagaaggggaacaggccttccacttacaccattgttccaggcccacaagagggaggcaggatggactttctgcccgacccctgctactgtcttaggacttgtgaatttgcatatcggtagcatatttctgaaatgcccttcttccctttttctctcgtctcctcgtataatccaaacttttgcatcctcaaggacctaataaaaatgacttatgctgtcactttataaatatataaatatgaagtatttattacagcatgcaactgctaaacctttgaaaactgtaaagttgatttaattttattattgaaattactgttgaaataagtaactattcaaacaaaatattaaagaataaaatcatgggctttacatgtgatgacacttaatgtgagtaataatactttagactccatttcaagcctcacataaaattttaaaatacacttttcagtatttaataggtgctgttaatagcacagtctaaatctattcttgaatttactacgtaaaattacattttttatcatgactacttttaaactcttttccaccaaggaaaattccaaatgaaaaaaatatatatatattttttctggttttacaaagttagatttaccaatttaatatctaattagtcactgtgctccctaaatttgtctcgctccattaattgggctgcccatgaatgaagcaaatggtaacaatgagaaacaagtagagacatcaaaaatagcattcagggaaacaaatataatttttgccttctgtaatatttctaggaaaaaaagttttttttcttggcagtaagaagaaatatggatggaacttaacaaagggcaaaaaaatgtcagtataaacataaggataataaatcaagtgattttagaattttgcaaatattaaaattctcattcaccgtgcaaccggtatttaaaattacactgctgcttcatttatgtgcagcataacttattttctgatgttctaaatcaagttagtcagattattctcaagcataaattacatttagggagtaattcggtactctggggcatactttaacactttcgggccattaaggtggtagtaaattccatgaaatagatttaaataaataacaccctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttgtttttttctcatgtcagtttttagtcacctgggattttatttttgtatatagtttgaaacagaatatatacttttttcctaagcaggagactccattttaattttttaggtaaaacatgtgcactgtacaagataatgcatgaacagcagaaaaataaaagtgtgtgcagtgaaaagcatctgtcccaattttgatctgctcactctggtagttctgctctcactgttaataaaaattttataattttaaatatttatagaacaaggcaaagaaataaacacagtgatataaaatgatagtctcctcattcagttttactgctttcaatatattcaatgctgatatttttacaactctggattgacattatactttgtaacactctattttattgatccctaatcctccctaggttgtgagccttgttctcaggcttcaaatacgtttggagtcatactttgattttaagtttctcacagtgtttataatacttgagcttaggaactcattctcatgcctttatcccctctcttcgctgttgaaattctacacattttttcccttatttctcataacttcacttattgcattctgaataaacagcaaagataaattttctttgacctgtaccaccaacatcaacacctaaagtgacctctttcccattataggggactcttctactgtgcttaatggagactaggatgtgttcccctcaaaggaattctagtttttataggtaaacttgttaaatgtcttgtatggacactgccttatgaaacctcatttgctttcaaagcttcaactaacatctacagcaggtattggcaaactttatagataaagatcttgagaacaaatatttcaggctttgtgggccgtatggtttttgttacaactactcaactctgccttgaagttcaaaaaaaaggtatacatggagcataagcaaatggatatggctgggattcaatactactttacaaaaacaagtggtgggtgtaattggcccatgggcaggagattattgactcttaatctaggctgattatgacatagctccaaatttcagcccttatctgaggtatatagccaactgctacttggactatcctcatcagaacatttgatgtgaacctcaaagatgttatgtcaacaattccttattttcccatgcaagtctttgatatgatttggatctgtgtccccacccaaatctcatattaaattgtaatccccaatgttggaggtggggcctggtgagaggtgactggatcatcagggtggtttctcacggtttaataccatcctcttggtactgtcctcatgaaaatgagtgagttctccaagatctggttgtttaaaagtaggtagccacccacccccaccaccaactctctctctctgctttcgccatgtgaaatgcctacacctgctctgccttccaccatgagtaaaagctccctgaggcctccccagaaacagatgttgctatgcttcctgtagagcctgcagaatcgtcagccaattaaacctctttactttataaacacccagtctcaggtatttctttatagcaatgcaagaatggcctaatccagtccttagttttaattttagtcaatgatttccaagctagaaatcttgagaccatcgtttacttctcgacttctttcttatcatgcttgtctctatattttatcaattctaaaccagaaatgactctttaatttagcctcttctctctagccccactgtcgtggcctttcttgaaaactcctaataacttttcctcagcatattccaactcatctctccctattttcggtttctcagcgctctctaacagacaacctcacttcctactttggtccctatacaaacattcacatagcccaccatgtatactgtactgaaaacatagaaaatctgaaaattttcataacaaccaaaattccttttttactgtgggccttttgctgtattttagaatgacaccctatctaaaatgtcactattccataaggcttctctcccttggaattagttacttcataagacaagcttccacagctttgtgaaaacctctattaacatactacttcatgttctaattatgtatttacaaggctgtttgttccagtacactatgtacctcttagaataaggaagatgttttatgcacctttgaattcctggtactaagcgctgttcctggtacatgataaatgttgaatacattttaataactgaatgaatgaataaaaaagtccatgagtaatttcacaaaccccttatatcttccatttaagagccatgaatgcttggatacactattttacctctgagtctcagttatctcacacataaacccagaataatactgcctacctcattcagctttttcaggaggatgaaagtacactccaagttataaatagcaataaaatttagtattatcgatattaatacagttagtaatctataaatttttaataccgacacagaatttagaataaaaaaatcaatctacatcagaaatcattttccaaatatatcagcaatcacataattgttgttttcattaataaaagacacaaaatgatgattcttaaagataaataatttagcaagttcaacaccatcctaaaaagaatacactttgcacaaatttactgagacctaatttaaatatgaggatgcacatttagggactgtgactcttttaaggtgagtgttttaaaccaaaacaatattgataaaattcaccctaaagaagtcaatagcattatttaaaaacagatgattggataaagaatatgtggagatatatctccacatattcttttatttatatgtgtgtgaatgaatgtattccattgtgtagtattccattgtgtgtctatcctagcttctaagtctaagcatatatatatatatatatatatatatatatatatatatatatatatatgtacacacacacaaattgcgtatggaataaacaatttcatatacacaatgaaaaatactacaaagccatagtaaagaatgaaatcatgtcttttgcagcaacatggatggaactggtggtcatcttaagtggaataactcaaaaacagaaagtcaaatattgcatgttctcacttacaagtggaagctaaataatgtgtacacatgcgcacagagtgtggaataatagacactggagactcagaagggcgagagggtgggatgggggcgaaggataggaaattgcttaatggagaaaaggtacatcatttgcatgatgggtacacaaaaaaccagacttcgccactctgcaatatatccatgtaacaaaaatgtacttgtataccttaaatttatacaaacaaaaaaataataaaattacttaaatgttgattgcattatttgtaagaactcacaaacaattcaggttatcactaagactattaaaataaatcttaaaattctttagatttctaaagtgttgtttaaactttgctggactcttattgggcttaaatctctagacaggcagatctgtggaggaggacgctgtaacagaaaagcctcatcaataagctgaaattgctttagataaacgaggactttttgatctgaaagtgcacacaaaaatacatatactttaatatgtatataagtatacacacatatcagaaacttggcctgagtgatttttagggggctaaggggaccttaattaagcactctattttggcttaggggaaaacaccgtaaatatccttgagataaattgataagtactcaaatagttagagattcatttctttacctatgcttggtatctgattatttaactccttagtaataacaaagaaagcaaaagtgtccctgatattactattgtctagaactccgcaaattttctttgcccttctcttttataaatctctttgacacaatataatgttccagcagacaactgacaatgtaaaggttgtgatatttgaaaattccatcatgatggaaaaatattcagggtgtactattcctgcactgcttctgaaaaaatatgtaggattatgctaatattaacctaaaattatgcaatttcaatgtcttgatttggcacaattagcaccctgtaaaaatacccaaagtagcagaaatagtttgctattagtgatctgtaatgctacttttaataccaagaccttttggagaaatcagctacagaaactgactcagcaggctaagttaaataatttaaatttcttaataagtttaaactgacatactctctgaggatttgatatattcaagggtctcctttataaaatgtgagcatttaattgagtcttaatttacatatcctctactatatagtccacatgaagaggatatggtgttagacatcctagcttccaagtcttagctttcatttgttggctagaggggatatttgaaataatgatgcctttctcttcattcaaacacaaaacatatataataggtgtaggaacttttacccagaaataggagcaaaagcaaccacaaatatatgctatgcactctaattaaaacttcagattaagtacatgattaaatatactccacagcaccttggggtaggtactatcattttattcattttgcaaatgagaaaactgagactttgggagtctaacttgtatgtttctaatcaggaatgcaagacaataacatagctgaataaggatagcttatagtgtatgttttttgtttcttgttttttttaagtgtcatttgaatcagtaaacactgtattagcttgtgaaagagaaaaaatcctacttctcctataatatactatcctcttggaaataaatcatgttgttattggatagttacactcacgtgtttctgatcatgaaatttatatttcaaaggaatggattaataaataacctaacctcctttctaagcagcatttgctcaaaataacatatttctagacacttctcattatatatcatgacaagtacctcatactctcaaatcaaaatggaatttctcttgatttttcagaaacatccttggtggttcttcatcttttggtttatttttgtttatattattccttttcttaaagtatcgttgcttatattgtcctaaatttttctataccttcctccatgagaacctttctgatactaccaattagaagtaatccctcccctctttaataacactctttttattagggtgattatttttcttgattcttttttgtaaccaccttaatgaagtatgattgacatacaaaaagctgtacatattttacatatatatatatatatctcaaagagtttcatcatatatatatatatatatatatatatatatatatatatatatataaaatcaaagagtttgggaataagtatacacccacaaaaccatcgccaccatgaaggctataaacatatctgtcatcactcaaaatttcctcttgtcccctttattattgttgttactggtggtaagaacacaacataagatttcttaggaaattttaagtgtccgaaacagcattattagctataggcactatgctgtataatagatctccagaattttatcttccataactgaaactttgtagtctttaacactccttttgtcctgctttaaagaatttattctactctaatttacattagtgtcattacgtctaaaccacactaaatgctccctaagggtagaaactatattgaatcaccatttttacctcctataacaggtgccaaaaaataatgttgcacttaatttttgcagattcaaatttatccataagtaattttaatacaaataattggtatccacttcaaatgagtataccttctgaaaagaaacatggttttttttgttttgttttgttttgttttgttatttttgagacggagtctcgctctgtcaaccaggctggagtgcagcggcgcgatctcggctcactacaagctctgcctcccaggttcacgcctttctcccgcctcagcttcccgagtagctgggactacaggcgcccgccaccacgcccggctaattttttgtattttttagtagagacggggtttcaccttgttggccaggacggtctcgatctcctgacctcgtgatccttctgcctcggcctcccaaagtgctgggattacaggcgtgagccaccgcgcccggccaaaaacatgttctttagaactcccaaagtatcatcttttagtatgaagattttttttgaaattaagaacaagtagtaaaacaatcaggttgtacagcatacaaaatttgaagacaagcaaacgtgagtttgaaattctgttttattgcctaacagtgctttgtaaacttcagcaagtgatttaatttcctgatttcagagttctcatttgtgaaataggcataatatatatttcacagggttgttataagaattaaaaataatacagtgaagttttctgagcccatagtaagtgctcaatggtggcaataacaataatcataatatccaaatatatatacagtatataatttctgttatttagaaaatattaagttatcaaatacatgtacacatatatgaatattttcaatatctatgaatgaggaaaatatgtataactgattttatacatttcctcattggcacatgaaagttgtatatcttcagctaaatttagtcttcttgccctttaaggctcaaacattttactatgtgtaaatgattttactgctattgtaattgggcaaaccaaaacaattacagtaaatggaatcatatgtctttgtttcgttctcaacgagggaggaacagtacacttaacacagctacaaaaaaatttaacttacttttttctgctaaaggaaaatgagatgaaaaagccattttattttaaaacgaatggcagattttgatttcgaggcaagtaaggcaatttcgtgttatcttcccaaaagtatggtgagaatacgaattccaaatatgcggagtatgaataaaaaatagaaaggtatgacatttttcttcttaggcagccaaaatgatatttcttccataggctgctgcggcaaatcaaaatacaccacttgagatcagcttacgaaaatgtcccttttacatgggactcattttctttggccataaaaaattaaagattaagatctctgtctatctttgaatatatatggcatgagaccacacttacaaatacataaataaaactgaaacaattcactttttacttagctttattctaaacgggaaattctattttctctcttactactattctactttctctattttctctcactggcaccattaccttccacaagactgtttttcctgtgaaggtagttataattaacaagagcctatacacacataaaagttttcatttaccatattagtgaacatatcaagctatcatttttcttaatgtttactaagttttactttattgaaaccaatctcaaaggttgcagcatttaaaaaagtgacatttataattctcaattataaaataattttccaaagaaagaaaaaaattccaattttacttttataagttggaatttactatatatacacacaaatatagtatgatttgtgtgtgtttgcaacacacaaatatagtattattgaaaaaggaggaatttagatgttccaagtggcattaacagaaaattagttctgaaattatgccagattagcatttcaactagaaattatgccagattagcatttcaactagaaatagcaaggaaaaacttctaggctataagaggtcataagtagtaaagaaaataagaactattttcaggagacatgacctattctgccgggagttgcacccataaggcagagggaacgggtccaaaatattttcttataaaaatagagatacagtaattaatttcaaggcagatttcagtttatctatttttgataaatttgttaaatcaattaaatatgccaggggccccttattaggagtatggctgtaaggctaattttagtttgaatctactgacaccataaacattaagaggatttcacccccactcctacccactccctagcctgtatgtaactgtgggagcagggcagttccaggatgacaccatgttagaaagacaacttcactgcaaatttactgaactgaaatctgacccaagtatagcagctctaagtcaaagaaaatgtcatcacatctgacttactaccttatgagtaaatatcatcacaaaagtcgggccccttttgctattttatattctatcttattaaaacacaggtgcacgagggaaatgttcttggcataaaactactacattcattaaattttttctttcccacaccggaaggcacatgtctaaacctgtaggggttgctttattatttaattagagcagattcttttctatcattttaggtgtttcatctaaagtttgattaacatcagtatatgctgtgctctcaggcaagtaaatatagctgccgtagaaagagaaataagcagaagcaacattttaaaaaataaagaataacatgaacatggaaagaaaaagaacctttaagaaataaaatatccacaaagctcactagaaatgcttcctaaacgtgtatgaagcgtatgtgtttgtacattttatttcaccactgattcatttactcaatcttttgataaacatttattgagcgcttagtcctgaggctagcagtgtgttgaattcggaaggtgtaaagctgaaaaagatactatctctatcaatgggcaattgacagtttagttgcacagtattttaaggagggtatgaactgaagttgtagcacatgctgtacttgctccatgcacttccccttgcctttccatttcaaaatacactggtttgacttccaaatgccagcatttggatttcattacctatggaatctttctggttgcagaggtctgatgctgatgttactggggtggggagcatatttttcaaccagtggcatggaaggaatggcccaagggctagttgggcaagatgtactagatcaacattatgaaggttcatgaatatcaaagtttttgagttcatttatgcagaagtagtttattgcaaaagagtaccacacaaaataaatagctgcagatctttcacaatacaataaattaaaaaaacttcttggagggggagaatatatagagcattcccaatccacttcctggtacaatttctttttcttttatttatttatttatttatttatttatttatttatttatttatttattgagacggagcttcgctcttgttgccccagctggagtgcaatggtgtgatcttctctcaccacaacctatgcctccagggtggaagagattctcttgccttagcctcctgagtagctggggttacaggcatgcgccaccatgcctggctaattttgtattttaagtagagagggtttctccatgttgctcagtctggtctcgaactcccgacctcaggtgatccgcccaccttggtctctcaaagtgctgggattacaggcatgagtcaccacacccagcccggtacaatttcttaggcttcattttgtgccaaaattgtatatatatgtaagctatacttcaccatgttttccattaaccctacaactgcgatttcggcagcttcatgcttctcaagagccatggtatgggtcacagtaaaactggctggtccaccaaatagacagcagggacggcagtggtgaatagtcccatgaccacgagagaccagaaagaattagttgtctatagctactcttgtctgtgagattatagttcattttcgccttgaaaggaaggttttagttatgttgggtcaggaaaagacagatgggttattatttattgcctatcagttttaaccacgtgcaaatgaacgttatgcaagatgagagcataggagaagctagaagtctaatcagttcttgaagaaggaaagtgaaattgtgacatttgacatttaaaaatataattttgtaagctataaagaagggggtggtgagaagttagaatagtggtttgcaaacttgctgtacaatggagtcatccaaggatcttaaaaaaaaaatacaccagagatctgattcaactgatttgggacatggccagggcatcagaattttcacccaatattttaacataacaaatttcaaaaatgcaataacatttttaaaaattacaagtgatatctatatatctagattccaccatgaacattttactatactcgttttgatcacatatcttttccttcctccgatccatccatcaatcaatcatatttttgatgcatatccaggtaaactgctgacatcagtatcattcaccttaaatacctcaatatggatatcactgaatagaattcataaggtttctttattattatgttattatttactgtatttggtgtcctctttaccttatggccaattcaagtaataactctgcaaggtagttattacttagaaggaaaaaaagattcagagacattaagtcatcttttaatgttcacatgggaagtaaaaggtagagttggattcaaatccagctttcacttatcccataaaacagtggtccctgacccttttggcaccaggaactgattttgtggaagacaatttttccgtggaccgggttggaggatggtttccatatgattcaagtgcattacagttattgcacacattatttatattattatcacattataatatataatgaaataattatacaactcaccataatgtagattcagtgggagccttgagcttcctttcctgcagctagatggtcccatctggggggtgatgggagacagtgacagatcatgcagcattagattctcataaggagcatgcaacctagatcccttgcatgagtagttcacaatagggtttgtgctcctatgggaatttaatgtggctgctgatctgacaggaggtggagctcaggcagaaatggagtgatgaggagcagctgtaaatacagatgaagcttccttccctagcccgctgctgctcacctactgctttgcgaatcgggtccctaacaggcaacggattggtacgggtctgtggctctggggttgaggtaccctgccataaaatactatatttttttcatttttccaaatgtctctaatgctatgagggtagaagtggaaaggagtcgaattagatatttaatttgaagtctacccattacaattttggaaggttagaggccaaaagggggtgtatcttgttttattttttcaactttttctaacatgacaactgttgaaaaataagtatcatgtacaaaaggtaaataaaagtggccttcactttgttttcatttggagtatttattcatcttataatgccttaacatggatttttaacttaatgaaatcgcccttaaatttgtcattaacagactattgttttagttttagtgttttttaactatgaaaatattgtcattgtattaaaaaataagaatttccaagttacaaaatgacagtgaaaaaaaccagccataccattccaccctcacataacagctatcaggatgaagaataatttttctctttatcatttattagttctctaacctaattttttaaggaattcatttaaaatcatggtaaaataaaatgaaaatataactaataagatagtatttgaggtgataggatttcctcctcagcaatgaaaatcttacataatcatttaaagaccggtgaagtgctgaaaatcagacaaaattacaatgtgaaaatcatcaagaggaaacaagtctattttaaaggaatgccaattagactgacaacttaccgttcaacagaaaatatggaagcctgagaacaatcatgctatcttcaatgtgattaactggaatgctgtttggtaggacatgccatcctcagtttaactagattattgctaaattacactctaaattggttgtaccaacttaaatttctacaagaatgagagtttgtgacctttcacaatcttattttattttttacttgttccagtccgatgggagtacgttatctcacttagtacgatatggtttggcagtgtccccacccaaatctcatcttgaattcctacatgttgtgggaaggacctcgtgggaggtaattgaatcatgggggcaggtccttcccatgctgttctcgtgatagtaaattagtctcatgagatctgatggttttataaaggggactttctttgccttctgccattcatgtaagatgtgacttgctcctccttgccttctgccaagattgtgaggcctccccagctgtgtggaactgtaagtccattaaatcctttttcctgtataaatgacccagtctcatgtatgtctttatcagcagcatgaaaaccgactaatatgaagtaatttttccaataataaatgagagttagcatctattcataagtgtatttgacatacagatgttctgtgaactgtctattattttttaaactttaaaaatattttcctgttaggttatttttattttgttctattgataggtaaatatttttcttaaattatgacataaatcctttattgttttagtattgcaaatatactatctgagcctatgtcttttctttgtttatgaagtctttgcattgtacaggtttttaattaaaatgatcaaatatatgtctttttctttacaatttttgctttgtgctgttgcttaagggacacctcttttgccctacatgccccaaaatatttttatatattttaatgctttgcctttcatgtttaggcaatccatcaatttaccatttttatgtttatgtacagtgtgagatagggatctaattcttatgtttaataaaattttaaatggtacttctgtctgtcatacatgtcatatattatactcttacacaataagaataccacctctcaatacattcgaatacattagattttttttttcttggtaacaaaattcctggagcactattttcttctccaatctgtacaggtttctctctacaactgttatacagctgttgttacaggatctcctccaccatctttctggcaccactttgcatcttcctcccacgttgggttctctgttttccggatcctaggctttgcaggtaatactaatgctccaatattttcctaattctcttacctctcttaaaaatattagtgattataatcccctgtcccctcagagttaggcatgaccacgtgacttcctttggatgatgaagtgaaatgaaaatgacatatatcactcctacatagaggcatgtaagagtcagtttaaaattttccacgcatttttgactgacatggtgaacgctaaagcttcttattgttacggtagaatgatagaatactagagactgaatcagcttagattcctgagtgactacaatgatcagaacccttgactgacttgtgttggatatgttgcaaagatacaaaatcaacctttgtgtttctagccactaatattttggaattgcttattattgcagcataacaaggcgaatcatgcctaaaacactctccttctgatctccaatcacaactaaacattctttgtctttcttggtttctttcttcacttggtagagtatatttttgaaaatagatttctggggaaaaaaggtttaggggagtacataaggctatctctgaaaattattttctccgcacaatttatagtttatcagggtgtacaatttatatattgttgaataacaagtcattccaaaatttagcagcttaaaaacaaaaatgtttattatttggcagtttctgaaggtcaagaatctgagagtggcttagcagggtgggactggcatagcttattttatgaggttgtagttaagctgttgtctatgcttgcagcctctcgagatttgtctggtgttaaatgatgcacttctaagctcattcttgtggctctttgcaggaggccttagtttctcagcatacgtgcatctccatagggctgctcatgacatgtgttcccacagaagaagcaatgcatgagagagagagagagagagagagagagagaaagagagacacagagagagataggcgtggatggagaacacaagacataaaccacagtctttctacaacctacacttggaaatgacatatcatcacaaaagagtcactgaatctagtccacactcaatgacagggacatttagctgtaactcttgaatagaagagcatcacagaatttgtgaacataatttcatataggatatgaaatcaaagccaaagttaattattcctagaagtttaaaggaagtgttcctttctgctattttccatggctattgctgaaaagtccaaagccattctgatttctgatctgtgaacttctctttgtccttgtttttgtaaaaatttatgatgatgagccttggtgtagatttttagctcatttgctgtgctgggcatttagtaagccctttaaacctggacactcattttcttcagttctaagaaaactgatgttgtcacttctttgataattttctctccacagttgcctctcttctgttttatttttaacatctattatttgaatgttggattacatagaacaaggtttctaaacataaacactattgacactttgaaatgagtaattcttggttgtggatggctgcatggtgcattcctcttgcgtcactcttcacaagaggccagtagtacatcctttccttatttgtgacaacgaaaaaggtctccgtacattgtcaaacgtcctctgcaggacaaaatcacctctatttgtgaaacacttacctagaatgatcttctaagattcttatactctcccattttccatgcttttggctatttatactgctttatgagatatttcttcaaatttatcttctacttttgaacttttatttctgctcttcatttttaatagacttgattttttaaagcaattttacatttatagcaaaatcgaggggaaagtacagagatttcccgtatactctctggcccccttcctcattacacacagcctaccccgctatcaacatcccacaccagagtggtacatttgttataactgacttacatacattgatatatcattaacactcgaagtccatagtttacattagagtttgcttgtgatgttgtatcttctatgggtttggacaaatatataatgaaaggtatccaccattatagtatcacacagagtagtttcattgctctaaaactgctatgcataccatgtatgttattccagtggtggatatactaaaagctctgccttcaccactataaaatatattcatataacaaaattacactggtaacccataaatttatacaattaagaatttaaaaacttaacctgctatactattaatttaaataacccttatctttctcggaaataccaccttctatagtctcttgttctttcttatgaatacagtgactagtctcactgtgagataataattttatagctatctttaaaaagttttcttaaggtctatgccttgtctctctttctgcagagatttctgtttcatttatgtggctattgtttttttcccaatatttctgctttttgtttttatgttggtttctgtcttccatctttgagacatgttcaaatatctggaaatccttgattgtctcttaaaactgaggcattaaatgcttttggaaattccttgtgcgtatgtagggcttatacttggtgggcttcaatatatggtcattaggcacagatctggctatttcactggtggatcattacatatcattaattgtaggttactatgatctgagtgtgttcttgcaaaatttatacgttgaaatcctcaccctcaaggtgatgacattaggaagtggggcctttggaaggtaattaggtcataaggccaaagccatccagaatgagaatagtacccttacaaaagaggcccaagacagttcccttggacctgctgccttgtgaggttacagtgagaagacaggaaatgagctttcaccagacaccaaacctgccagtgccttgatcttgaacttcccagcctccagaacggtgagaaataaaggtctgttgtttataaggcatccagtctatggtattttgttatagcaataaaacttgactaaaaatagttttcgtattgcaggtaggctctcaggagaataaatttataatctactgcccagaggatagaaacttaagagccaagaaggtgaagagggactgctggtctcaccattaaatatgttgactttaacttaatcctgtattttcagtatggtggctctctcttccatcaactaatcctgttgtccaaatgccaaaagttgtttcagcctcaccagaaagcaaaccactcactcacgtctgctgggatgagagaggagtagtgtctaattaactaccctgagctggggacatgaaatgtaattgccccttttaagggattcaaaacaacccctttatttccagcccctctcgggaatatatggccttctaaaacacctagcgtcttcaatccacaagtttttctgggatcctgaaaaacaaattggcttacttgtcctaattttcatctcattgacttgatatgtctgtgcagatgtctcttcttccattttatttgtcattttatgactgtattgtttttattcccttagcgtaatctttgaacaatttgggagagagagaagataaatgtatgttttcgattgtcatttctattggaggtccatgttcacgtttgtgtcttgttctctctcctcaggtatcctcatctagcatttagtagttgcatgtgcatcgcgtcccgtggtctccagccacccctttaaggtttaaagttcttgcactgcaatgttactggggataatttcaatccattcatcaagcaagagaacagatgcaacacagttcccagcagcaaggctatgtctttattcttacacctacataggcccataagtttaggcaagccatagcgtcaggctacagcctgaagaagcactttttccccaggttttctttcacgaatgcaagcaccacagcccagcctctggttttgaatactgagtttgtctccagttccacaccttgcttgaagcaattttaatcccaactatcccgcagcatccaaattcctggcttccactgttgttttgtggttcagtgtcaagtctgtcagggacttccgccccattctctgctttacatttctgtaaatatatttctgtaaatacacatcatgatttgatatgtatttgattatcttgtcatcaacatatatttctgtaaatacagttctgtaaatatatccttttttattttctattttttcattgctgtattttgggagcagatgaggataacacttggattagaaatctctaatcattttgcattggtttttataataggtaccagcataacgtatatttttccataaggcatatacccaatagagggaccactattttatagccttaagtggaagctctgttatgagacatatgtgtctcaacccagccggttctatacagtttacaagaccaggtagatcatcatgctccccagagagacccaagataagatgattagggttatttttctagcacataaaatagacttccttttctgacatggaggcctgaatcctaaccaaatttccttggtaactgcaacaagaactgtctacatattgttccaattccaccttcagtccttcagggaacagtgtctggtgtgtggcctatgtaacattacacagcactctggagattccacagatctgcaggcctagtaacaaaaatagaagttcaactaaccaatcaaccaacaaggatcactctgggccacctaagtcctgttacagaagacaaagtaatgatcagtctcatcactcccctcctttaaacttcagtgtccttggtactaataacactcatgttggaaataaagccaatagaatcattctgcatatgctttattacctgaaataccacctttaacattaccctctgatgactttttaacagttaacttcaatgtctagcacgttgctatatgtctattttttttcaataatggaagcactagaagggaaatggcattattatgtacacgaaagatttatatacaaagagtatgtaacttattttatttgttaatacttttgctacttttccaaataagaaaaggtaaaacatgcaccctataaaatcacatggaacattttggttaaaaatgcttctgtgtgttctaaaacattataatacttcatttcttgagggttggattctcttatcatcaataataatatcatgtagttagaacgcattggcatagatatataatcattttatgggtccgtgaaatgaggatagaattgggaggtcacaatttttgtagcaatatttttgttattgttagtttttttgtggtactgaaaagaaagcaagcgaagaaagcaaggaaagcaaaggaacgcaaaggaaaaggaaaaggaaaaggaacagaaggaaaggaaaggaagaaggaaggaaggaaggaagaaacaaaagaaaggaaaggaaagcagaagtaaagaaaagaaagaaaaaaagaaaaaccaagcaagcaggcagacaggcagacaggcaggcaagcaagctagttaagtaagattttagataaggaaataaataggaataaataggagatgaaattatatgatcctagggctagggtaaagaaaagagcaaaaaggccataaaatctttctgtagcgtaataataaaaataacttcaaaagtgcttgggttgatgatagcctgacaaggattagcttgggtacataccaattaaagacagctggtctagaagctggtttcacatgatgctacagtaaactggtaaagcaagtattaaaacctaaggaacaaactctcctgtgatatttactggctcaacatcttaaggataaaagacaattatatgatgttaattaagacagtgctatgctggtaaatgtctaacaatcagatcccctgagaggaaggacatatttgaatattcccagtatgtttaattttaagctatcattataatgtcaccaaacatgaagttagcactacaccattatacagtcattccattatacaggtaacaaacccgtagataatagtgaaatataataaaagaattaggtagtgatgacttttgtgcatctagtacatttgtgaacaatatatttcatttaatgtaagttaccataatttaatttttgataatggttgtgtttaacagatctcaaaattcttgaaaatttaacaagtatttccagcacatcgactcaagttaaacattagtttatcacaatgtacacaaaagaagaggttcttatcagtacctatcccatacatcattaatttttcctattcttctcaggtattagtttatataaaattttgttttctctttgaaaataaggagtcttgcatttgtatgaaaattctaacaagaggaacgaacttttttttttttattatactttaagttttagggtacatgtgcacattgtgtaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccaccccacctatgagtgagaatatgcagtgtttggttttttgttcttgcgatagtttactgagaatgacggtttccagtttcatccatgtccctacaaaggacatgaactcatcattttttctggctgcatagtattccatggtgtatatgtgccacattttcttaatccagtctatcattgttggacatttgggttggttccaagtctttgttattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatgatatctcatagtggttttgatttgcattactctgatggccagtgatggtgaggattttttcatgtgttttttggctgcataaatgtcttcttttgagaagtgtctgttcatgtccttcgctcactttttgatggggttgtttgtttttttcttgtaaatttgtttgagttcattgtagattctggatattagccctttgtcagatgagtaggttgcgaaaattttctcccatgttgtaggttccctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagtcttcccagcaccatttattaaatagggaatcctttccccattgcttgttttcctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcagctagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaatcaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttctgtacattgattttgtatcctgagactttgctgaagttgcttatcagcttaaggagattttgggctgagacgatggggttttctagataaacaatcatgtcgtctgcaaacagggacaatttgacttcctcttttcctaactgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccaaggatgaagcccacttgatcatggtggataagctttttgatgtgctgctggattcggtatgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgacggtagtttgtatttctgtgggatcggtggtgatatcacttctgttaactctacaagtcaaacctgaaatcatggctcacaaccagcaccacctaatgtcaggcattggaattgcatatgtagagcccagaattggttttccacgtacttcagagtcaaatgtgaagctaaatgcacacacacccacacaccctacagatatggccaggacccaccccagaccaaataaccaggatatctaatttatttttatagccatgtaggtaatttaaattcagttgttgaaccaagtttgaaaacgattgtcaaagaaagaggtattactgtaattctgattttaaaattttacatcatgaaaatcttcaaagacatatataagtaaagagaacagtatattatggacccccatgcacctgtcaccaccttgagcaattatcaacatttgcgaatcttgtttaatcttcctccattgctctttatattaaaaataatttccttggaagtttgtcaaaacaaaacccacgaatcacattacttcacctgaaaatactttggcatgtatctagaatttctctttaaatagcacaatctattatagtagcaataaatgccaaaaatcgttaagtatttcttttaaatattgagccagatatgatggtagttgctgcagatgtgaaaaaccttagtgacaattattttttaattttatcttacataaagccagttagattcagagacacatttggtcaaactttgtccttgacatataaatagtgtttctttcctaaactttccattatctggttaatttctcctaaactttccattatctggataatttctcctcattttttagaactcaattcaaggatcatctcacccggatccttccagactgagacccccaaactgtgttagacagtcctgctttggtatatgcctagctcccaaggcagacatgaactgaggactcgtcactgtgcattaaaactgtgagttcataattcctttctgtatatataaatacagaaatcagggtttatatgttattcagttttatatttctagccctcagaatcatagtagggtcacactaatctttgttgaatgaataatgagtctatgaatgaccagtttgacagagtttaagtgtggatgtcaaggataaatgaagaaattagccaagtctgctaatatgaagatgtatatttaaatgagaagattttataatcttacactttcataattatgaccacattgatttgaaggttttatgaagagaaagaggttatactaattatttgagctgtttcttttcataagtgattgtggtcagccaaaattaaacaatgatgctacgaagaaagattaaggaaggatattatcaaacagccccaaacctgccagtccttcatggtttcactgtaaatgctcaggtacagccaatacttatatatgaattttaataatcaatatttaatgaaaatgccgttcttaaatttatctcatatttgtggtagaggagatttacaaaaaaggcattgttaacattagttaaaacacttatacaactgttgttaaataaaacttctgaagtcatatagttatttatttacttgtataaaccatcttatcatattcttttttggagctgtttacatatcttttaatctctgaactaagaaattaaaattgtatttgacaacaattagtgactcaaattataattaaaatatatgttgttacacacctcgacaagcaagcactcagaaacccactttatattctgtttctattaggatactaattatggcactattccaaaaaaaaaaacaaagaaacaaagtaattaactcattgcaaacacaatactattaattttaactccttggttctcaataaaatttgagctagtaaccacgtaattaattattaattgctcagtgcactccactatgccaagttaattatcaagaataacttggtgtgacttttattatgaatggataattacaaccttgtttttctagaattatcaggattttaaacatgaaaataataatgaaggtaaagatataggcattgctcttaaatatgctgatatgctaatcattatgaaataataggatgttcatttttataatagtatcattcttatatagggaccaagacaggatagaaaagtacttagaaagtactaagctaaacaaataagttaacaaaggatgaatcttttatatataatgatatatattcgtgaagtgaaaggccaattcttagttagacattagttttattccagcctaggagaattctcattcattcccatgctctaccataagaattacaaatatctaagtacatgtatgtataaacatttgctgaacctattttggttatgcattaaataatctttaaatgtgaacacaacagtaaaacatatgttttgttttcatcaattttatttcagttactgagtcagaactgcccaactgaataaagttttgtaaacatatagctttatagttccttaaatctaaatctactctaattttcaaagcacaaaaaaatacaaagcttatcaaatatcctactaaaatgttcctttgaatctatggtctcccatttgtttggtgatcaagagctactgttcataatttcaaagaatcttgaaataacaaagtggaaaagtgcttgaggaagagaccaggatacactgacaagtagctcagagtgctaatggcaagggtcagaatcatagctgtattatgcctattttacttatgagaaaattgaggttcagctaaaacttgccaaaaattcacacaatcagagattgatggagccacgattcaaactcaggtcaatctaattccaaagccaagctcttaactgtgtctgagactcacttatccctggaaaagctacaaatctggctttctcctgtcaatattcgacacaaaatgaaggcaacctttatacaagtggcttttatttctttctattcttgtccttggttcaaggatcgaacactcaaggagacctaaatattttggaataggagccaggataacctgtcctcagagatgcttccttggctgcatcacctagccataagtactccctttttgcaggaaaacttgcaaccctagaaccataccataccaaacttccttcattttctgattaaaactattttgtacataatgtcccactttttttgcatcacaaacgccttgaaccattaagtacacaagtatattcctgggaagatgaattaaggtcttcatcttgttcttagaaagtatgtgtttattttctgatagcagaaataataatactttatagttttatagaatcttctcaatggaggatttttaggagcttcacatgtatattactgattgcggagtgtttttattgcatatatctcagtgggagtattggaaatgggtttttcaacatttaaatatatgccatttaaaaaatcccacttcctcttctgcttacaatctattctctgtcttcaaagtgataatattcacttaatgtcgactttggaaacacataataaaaatggtaaatgtggattttcctcactctctttttagctaatattgtggcaaatgtcttcttccctttgtaagcaatattttctctcttttctattaagctttatttgcctagtttagcaggttttatttttctcctgcttatcgtattcctatccatgcgggtcaaaaggaaattaatgagctcttgtttcctctgacacaaaacatttttcttggtacacagttctgcctccccagtgttttcactctggacatgacggaaacagtgaaaagcaataggagatgggagaaggcattgcattcgcaatcaacatatggtcagccacttccaatgagttttcagcactgatgaacactatcactgctgtcttaagcttatgctggtgtccattactgtccactggctgctttgtgaaactacatctcctggctttcttcatacctcgatggtttttgtgctccttttcagggttattccttacccagtcactaaatgcattaaaagtacctcataaaacaggatgacttcatgtcctttgcagggacatggatgaagctggaaaccatcattcttagcaaactaacacaggaacagaaaatgaaacactgcatggactcactcgtaagtgggagtggaacagtgagaacacatggacacagggaggggaacaacacacactggtgcctgttgggggtggggggctagggtagggatagcattaggagaaatacctaatgtagatgacgggttgatgggtgcagcaaaccaccatagcacgtgtatacctatgtaacaaacctgcacgttctgcacctgtatcccagaacgtaaagtataataataattaaaaaaaaaagttcctcaaagatttgtcctgatcaatcttctacctacagtctctctttaggttattgcacccactcacataactttaaatattatttacatgcctaggtatcccacgtatgtatcttggtcacagatatttcatccacgtttcatgtagatgtttcagatgtatctcaaattgaatataaatctagaaaggtctccacctccaaatctgccccttcttttctgttctccagctcaatattatctaatatgctcagggatcatccctgacacttcactgtctttcaactccactttcaaatctgtcaaaagttgctactaatagctccattaacataagtatcaaagacatgtttatttccacttccattgccatctcaaggcttggtctatgctttggtattctaagtggccattctgttttcagggaggttccctaaagtacattgttttcagcaaaaacaatgattatgtcactaccttgctgggtgaggtggctcatatctgtaatcccaccattttaagaggatgaggcgggaggattgcttgggcccagtaatccaagatcagccttagaaacttagaaacgtaacaagaccctgtctcttcaaaataattgtttaaagttagccaggcatagtggcaaatgcctgtagtagtcccagctacccaggaagctgaggtaggagggtgatatgggaggattgcttgagcccaaggagttcaaggctgcagtgagccgtgatcatgtcactgcactccagcctgggcaacagagtgagattgtgtcttgaaataaataaataagtaaaacaaaatttaagaatcaaaaaataaacttgtaatggttttccgttgcacttagataaaatctatacttatttttgtggcctacaatgacttgtacaacgtaaaacttgccacgctctccctctctcaccataccccatacacaagggctttcttttagaatttcgaacattccaagatctctaccaacatctcaagactttgttcatgtgactccctacactctttactgagttgcaggtctctgcttcaatacttttcctcacagataattactctcagtctctagactgcagcatttctttttgttagaatatctcatagctccttatacttttcattcatagcacctactgcggcttgtaaatatacactcatgtatatgattattgccttaaaatacattttcccccactaaacattcagctccaaaaaggcagaaacaatgtgttctttgttaatttctgtagagtttttgagacaggatcagaattactatatgttgaataaatgaatacagaaataaaaataaagattatgatgcctttgctcactgatatatagtgccatatatatatatatataaacatatataaataaatatataaatatgtgtatatataaatatatataaatacaaatatataaatatatatatataaatatataaatatatatataaatatatataaatatataaatatatataaatatataaatatatatataaatatatataaatatataaatatatataaatatatataaatatatataaatatatatataaatatatataagtatataaatatatataaatatatataaatatataaatatatataaatatataaatatataaaaatatatataaatatatataaatatatacataaatatatatagatatataaatatatatatacataaatatatataaatatatatatgtttgtgtgtgtatatatatttatattcaacggtaaatggtttataaaactttcccgatcgattaagtattggtatggagtcagagaagtgagggaaaacagttttatctaccatctttgagatatcatggtgagatttaaggatacagagattaaatatattgtccaggtctttaagaacctcatagacagagtttatgtgtgactctaaaaaatagatgaagataagaagataagtatttaaatgaaaaaattgaggcggccaagggtttggggagcttatgactgtctttaaccctatcgacactaagagaatagaagttgcttactaactggtcacttagctgactgaaacagcttctctctttgtaggaagtttaagttccacaattactcggtgccaaaaaatactgtgtgctattcaaatttctggaggatgaaaagctacatagggcatatggcagaacgatgtaaagtgcagaatatgcttagctgaagattgtcccaaagctcttgggagatgtttatttggtgacaatcgcattcactttatattgtcagccctttgttagatcatccttactcatcagggtctgatccttgctttaattgtacttagggaattatttatctctatatcaatctaaaattgatttaatcttttttttttttttttgagatgtagtctcgctctgtcacccaggctggagtgcagtggcgtgatcttggctcactgcaacctccgcctgctgggttcaggagattcttctgcctcagcctcccaagtagctgggactataggcgtgcaccaccaagcccggctaatttttgtatttttagtagagacagggtttcaccatattggctaggctgttttcgaactcctgacctcataatctgcccgtctcagcctcccaaagtgctgcgattacaggcgtgagccaccacgcctggtcaattgattttgtcttacacaattttctcttctgggcatcactatcgttcatcctcatcttctttttcctctatgtttaaaaatgaaaactcttctgcaaaagagtttattaaagcttatttattctttgtttgtttttgagacagagtcttgctctgttgcccaggctggagggcagtggcatgatcttagctcactgcaacctccgcctcctgggttccagtgattctcctgcctcagcctcccaagtagctgggattacaagcatgcgccaacacgcctggccaatttttgtatttttagcagagatggggtttcaccatgttggctgggctggactctaactcctggcctcaagtgatctgcccacctcggcctctcaaattgctgggattacaggcgagagccaccacacctggcctattcttttttgttttatataagaagtgtagcatataataatgtgtggtggtgtggtagagataagaagtggtttttgaaaaggaaaatgatcacatatacattattcacttgctagttatgcttactgggtatctacttggccaaacaatgaatcaagtaacgaaaatgtaactgtcattctaaagaagttcacagtgtgtatgttgtttgtacatgtacagagtcatagaggtgagagagatggagaaaagtgatttaataagtaagtacacaaataacaaataacatgattcataatgtgaagggtgtttatatccacaatggaaatggaaattggtgagtaccaatttttattagatgttacccaccattgcattacatgcaattgttccatcttaaccatatcagctgcactaaacatggctcattactgctcactaataggaatacagatttatatcagcaatttgggcacatgggcttgtcttttttaactgtgggaaaatatacaaaatatttcaaccattgtaagtgtatacagttcagtggcattagatacattcacatggatatgtaaacatcaccaccatctatctccaaaactcttcatctttctaaactgaaactctataccaatgacacaagaactgctcatttcccctacccctccctggtccctggcaaccatgcaactatttgtctaagaatttaactactctaggtggaatatctccaaagttcatccctattttaggatgtgacagaatttcattcctttttaaagcagaatactgttctgctgtatggatacaccacgttttgtttctccattcttggtcagtgtacacagtgtacatttgtttctaccttttctctacagtaaaatatgctgctatgaacttgggtgtacaaatatctgtgtgaatacctgttttcaattattttgggtatatacccagaagtggaattattggatcatataatagttctttgttaaattttattttaagaactagtcttgtagtttaaaaataaagttttattggaatataatcacactcattcatttacatattgtctatggttgcttttgcaaaaaaaaaaaaaaatggcagagtttaatagttgtgagatagaccatatggcccgcaaagcctataatatttactatcttgttccttacagaataagtttgctaacttctgtcttacaaaattgcagtagcaattccttggtttcacatgaaacatatgtcttcaaacagttaaaagacctttcatgttgggaaatagaaacaggataattttattctcggcctacatatgagaaaacaaggaaagtgctgaatgccacatggaagttgcaatctcaaaggaagttaatccaatattaatatccagacctcattgttgcagctaaatctatctcatcacaaatcacagagttattttacttctttatatgctatatagaaaactcagatatactttccctatatcaatgcgatgtttcatgctttcttcttttattgaagatggggtgggaatactgcatcaagtgagagacttgagtctgggagaggctgagttgtataactgtgaaatcatttgtcctccaaaagcttggatttaaaatataacagattcacgtactatgtatgactgaaaacatacttgcctggaatgttaaagatcagggtaattttctgtctcgttaatctaatattgacagtggagtataaaagtctctcactattactgtgtaggagtgtaagtctctttgtaggtctctaggaacttgctttacgaatctgggtgctcctgtattgggtgcatatatatttagaatagttagttcttcttgttgcgttgctccctttaccattatgtaatgtaatacccttctttgtctttcttgatctttgttggtttaaagtctgttttatcagagactaggattgtaacccctgtttttttttttattttttttaattttttatttttttgctttccatttgcttggaaaatattccgccatccctttgctttgagcctatgtgtgtgtttgcatgtgagatgggtctcctgaatacaccacactgatggtcctgactctttatccaatttgccagtctgtgtcttttaattggggcatttagcccatttacatttaaagttaatattgtcatgtgtgaatgtgatcctgtaattatgatgttggttagttattttgcctgttagttgaggcagtttcttcatagggtcgatggtctttacaatttggtatgtttctctcagtggctggtaccggtttttcctttccatgtttagtgattccttcaggagctcttgtaagccaggcctggtggtgacaaaatcactcagcatttgcttgtctgtaaaggattttatttctcctttgcttatgaaacttagtttggctggatatgaaattctgggttgaaaattcccttattgaagagtgttgaatattggcacccactctcttctagcttgtagggtttctgcagagtgatccactgttagtctgatgggcttccctttgtgggtaacccagcctttctctctggctgcccctaacattacgagcaacttcagccaagtctcagaatacaaaatcaaagtgaaaagatcacaagcattcctatacaccaagaatagacaaacagagagccaaatcgtgggtgaactcctattcacaattgctacaaagagaataaagtgcctaggaatacaacttacaagggatgtgaaggacctcttcaaggagaactacaaaccactgttcaagaaaatacgaaaggacgcaaacaaatggaaaaaacatttcatgctcgtggttaggaagaatcagtggagtgaaaatggccatactgtccaaattaatttacagattcaatgctatccccaacaggctaccactgactttctttacagaattaggaaaaattactttacatttcagatggaaccaaaaaagagcttgtatagccaagacaatcctaagtaaaatgaacaaagctggaggcatcatgctacctgacttcaaactatactacaaggctacagtaagcaaaacagactggtactggtagcaaaacagatatatagaccaatggaacagaacagaggccagaaaaataatgccacacatctacaaccatctgatctttgacaaacctgacaaaaacaagcaacggggaaaggattccctatttaataaatggtgttgggaaaactggctagtcatatgcagaaaacggaaactggaccccttccttaccccttatacaaaaatcaactcaagatgcattaaagacttaaacctaaaaccgaaaaccatcaaaaccctagaagaaaacctaggcaataccattcaggacacaagtacggggaaagactgcatgactaaaacaccaaaagcaacagcaacaaaagccaaaattgacaaatgggatctaatgaaactaaagagcttctacactgcaaaagaaactatcatgagagtgaacaggcaaactacagattgggagaaaatttttgcaatctatacatctgacaaagggctaatacccggaatctataaggaacttaaacaaatttacaagaaaaaaaaaaacccatcagaaagtgggctaaggatatgaacagacacttctcaaaacaagacatttatgcagccagcaaacatatcaaaaaaagctcattatcactggtcattagaggaatgcaaatcaaaaccacaatgagataccatctcacaccagttagaatggcgaacattcaaaagtcaggcaacaacagatgctggagaggatgtggagaaaaaggaacgcttttacactgttggtgggactgtaaactagttcaaccattgtggaagacagtgtggcgattcctcaaggatacagaaccagaaataccatttgacccagcaatcccattactgcatatatacccaaagtattataaatcattctcctataaagacacatgcacacgtatgtttattgcagcactatttacaatagcaaagacttggaaccaacccaaatgcccatcaatgatagactggataaagaaaattggcacatatacaccatggaatactatgcagccataaaaaagaatgagttcatgtcctttgcacggacatggatgaagctggaaaccatcattctcagcaaactaacacaggaacagaaaaccaaacaccacatattctcacccataagtgggagttgaacgatgagaacacatagacacagggcggggaacatcacacaccggggcctctcaggggatggggggttaggggagggatagcattaggagaaatacctaatgtagatgatgggttgatgtgtgcagcaaaccaccatggaacgtgtacacctatgcaacaaacctgcccgttctgcacgtgtgtcccagaacttaaagtataataatgaaaaaaagatcagggtaaaatatattttgtcattgttttgaacatagccataggtaggatcataaaatagcacaacttaaatagaaaaataaatgattcagaatcaggtctcaggtacaaacagccaaaataattcaatgaaattatttctctatactacaaattgtggactcacatggcatcatatctgatataaataatagtttattttaaatgaatatagacaggagtggctggaaactaaaagcatgtatttcttctccataagatgaaagaggatttaggatacacttaagataacatactaaatcttgttttgccagtgtagcttctgcttggcatttaaatatctgttacttaatagaaacattcaattttggaccctaaaatatcacacaatattattcattaaaattatacctactcaaatctgtctagccatatcatatagcgactgatatttttagatcaaacccacaagtgtgaaatatttttcattttaaagactcttttacatttaatatgtattcatgctaactttttaaatttaaagcaccttctatgaaatgtattttaatacaaataccctatattgtataatttacttcaacgttgtaaattttccacgacgatgtgtatcattcacaaataatatgaaatataaaaattcacttaaacatatataaaattattggtatatttactttgtactaaatgtaatgggatttgatattattatattaaatttatattcatgatgaatataagtaaacattgagtaagaaatgttttaagaaatttgctatctgcatgaatgactattcaatacatttttattgaacatccatcgagttcgttgcgatgaatacagttttagaaaaaatactaatactctggcttcgaagactgctatgtattgaaggtctacaatgctttgaatgctgtaggaagacaagataaattaggacttttgatcaccgtcccataaaagcttataatttgtctaataaggaatagccaacaattattacaataggagacagtaaaaataagtagaatgcaatgttccagatgttcagaggagttggagatcatctccttatgggttggtcaagagagccttaatggaaaatgtagcatctgagcagggcatggaaggatcatttagtggatattcctctgtcccaaaattttttgtctgtccaatatcccttctgtggtgaagaaaattagtactctttggatatcttggtattgatttcattatgtttctcatgttcccttgaggtttcgtgagtgcaattgtgattgaatcctggaaagtgggaaagtgtaggaagtgatgcatcacttcttgcctgaggtacttgatagttagtgtcaatttctcagctctcctttgtcaatacctctgaagtttcaatgttgacatggcagagccacaagatgaaagcaatttaggtccctgagtcactgtgaaggaatgctacctgatttatatcagactttatatgagcaataaataagcattcattaggccactttgatttcagggttagtttttttgtggcatctaacattaattgttctgaataagtatctccactctttggtgaatggtaccctgcttttccttggatgaaattactcttccctcattctgcatgatcttagggggacctataatcatagtgctctgtaaactctataaactggtgggacaagttcctaatttatgccaattacatttagaaatttgaatctagaattgagaaaggtagagtcagtacaatttgaagctgaagcattttaatgacagcatccaaaaagtaacttccctggagttcctgactctcagtgctgccctccctctgccacagttgccttcttttccttcatttccaagaactatacattatccctccagtaagtttcatttcacttcagttaaatggagatggcttctgcttcttcgaatcaaagcttcctaatgtttacaggtggtgaggacttttatatataaaattacactccaaagaagtatggaataagggtattttagagaaaataagtacattttgctgtagagttgcatagagatacaagtgacagaagctaagttagggtttataagtgccagactatgaattctggatgttagcctctggcctaggaggttagaaaatcaaatgccttcaggggacacgtgggacacataaaattgtaaagccttagaaagtatagcaataagtgctaaactgatggtgttgatcagtccagtctctgcccggtttcattgccttttaatgttccttgcaggtcaaacaaagcagccaagcaaaacatatccttcagctctcttttctcctggggctacccgtttgaaatcaaagctatcaacagagaaacactgaaggttcctgtgctgggaaatgtgaagcaggagtgctgcttcagaaaggttaactctttcaaaagaaacagtgatttgggtggagagagatctcttacaaggtatctactgacttgcgattgatgtccaggagaatgaaaagggagggcatgaaaacataaaaagtgtacagaatccagtaaatggcaaaatattcaattaaagtgcagggaggtataaagaaaggacaacacatgttttaatctgaggacattataagaaataatggtggtatgttcttggaattgagaagcctaactaagtcacaggttataggaatcaaagtggtggtgctattgacttggtaaatttaagagaactttataaaatttgtgaattcgttatttctttatcttaaatgcaatagcactaatgcctcaaaagaacaacctacaaatgtctacccacagaagttatacaggctattttgtttcaatgaatggctggcccgagaaaatggttgcactcaagagagaatgtttgcgactgtttttggaaattcttctgtgggttgggtaataatacactcaagagacatgtttgtgatttttctgggaaattttttcgtggagtgggtaataaatagagcagaatattaggtgagaaatactcaatttcaggactagttattttaaactgttgtaaattataatattaaattataaaatttaaacattgtgaatatgttctttttctgtactcaggtattaaatcaaatatttttgggtaattagtggaaggtgagcttataaaaagattgatagcaaataaaacagtaactgcctcaactccagggttacttgatacctaagggctaatccaaacatgatagtatctttaaatacataatgtagacccataaactagtatcggaatcaaattacaatgtttttattgactttcttaatgtgtgtaatcacacggagatcatattattcacaaaatgaaagttagtagtttgtgagtgaaagaaggcagaccagaaataaggtacatacttcatgattctacttttataaaattctataaaacgcaaacttatctataatgccagtcagcatcagtggtaacctgggaatcaagggaggggcaggagagagtgattaccgaaaacagacttgtgaggatattggatatgtttattatcttgactgtgctaatagtttcactggtatttgcatatgtcaaaacttatcaaattgtactatttaaatgtgtagcttattgtatatcatttataccacaatgaaattgtttccaaaaaggactagcttggccaatacactacctaaatgcattactaggtatacaagttttacttaaaaacaatatatgtctcaataagtataaagattaccgtagcgaacactgtggtgtgccaccgagattcaccaattacaaatgaagcattcattctcccagttgctgggattgttatctactaacagatcatacctaagctcttccaagaaatttctctcagcagacaggcacttctttgaccaagatgatattgcccggaagctggtagttgggaggctcacatctaatgactaatggattagggatacaatggtccaccttccttgcttcatacggtaatactctaaatggtcatcccaaccccacatgggaccagataagatcttccatttcactgcatcatcattcaactcctctctctcctcaatcctgctgcctttactccctcccaggcatttttcttaaaagcactcactaagaaaccatctgcatggaaatctctgtcttagagtctatgtcttagaaaatccaatctaagataacaacctaatatgttgagaagttaaaatgtagaaaacagaaatacatatctgaagtaatcatttaaataacattatgaaaatgtacatcagtatttataaatagccattatatacaatgatacaattttgtttatcatttcttcaacttactgctagatttcagggaaaaatacaggatacaagtacttaaagaaagctcaagaaggagatatggctgattgcataatagaatattttgcagactgtcaactattgaggacgctggcatgtttggaagaataactgttattaaattttagaacataaaggtacaacatattgttatcaatcttaataaatccattcagcatttcagaataacatgaaaatatgccaacagaaattccattttactattgttactatcaagaacttggcaaaatttggttttttactttgtgaatgtattaaatgatacaggtaacatatatggaattaactatatgctaactgtagcaggtttcacttttcaataaacgaaatagccgtgacaattctgtctttaggatgaagagagagcattttccatgaaaatctgaattgattttcactatctaaagacatgaaacacatatgctagctctggacgacaaaagaagatgaaaatgtcctctataggaaggccatccaggatgttgaatggtaagagacaacttccatctaattatagacacattaaaacatggtccgttaactacaacccttatcctttccctttctaccaaccctcatttatccctcagccattgattttaaaaaatattttatatatttgacacccaaaggaaaaaatgtaaatgaaactcacttccaagagactactgctctcagcaaaccaaaaagagaataaaaaacaaatgtctacaaatttcttcaatgtagaaaaacaattcatagatcttaaaggcagtgatagggtttggctgtgtccccacccaaatcccgtcttgaattgcagttcccataatccccagatgtcatgggagggatccagtgggaggtaactgaatcatggggggtggtcactcccgtgctgctgttcttatgatagtgagctctcatgagagctgatggtttcataaggggcttttcctcctttgctcggcacttctccttcttgccatcatgtgacaaaggatgtgtttgcttctgcttccacagtgattgtaagtttcctgaggcctccccagccatgcaaaccagtgagtcaattaaacctcgttcctttataaattacccagtctcaggtagttctttatagcagcatgagaacagactaatacagtaaattggtaccacagagagtgggatactgctataaagaaacccaaaaatgtggaagcaactttggaactgggtaacaggcagaggttgaaacagttgggaggactcagaagaagacaggaaagtatgggaaactctggaacttcctagagaattggaggggtcagaagacaggaagatgtgggaaagtttggaacttcctagagacttgttgaatggctttgacccaaatgctgatagtgatatggacaataaagtccagactgaggtggtctcagagggagatgagaaacttcttggtaactgtagtaaaggtcacttttgctacgctttagcaaagagactggtggctttttgcccctgtccgagagatctgtggaattttgaacatgagagagatgatttagggcatctggtggaaggaatttctaaacagcaaagtgttcaagatttgacttgggtgctgttaaaagcattcagttttatgtatccacaaagatatggtttggaattggaaattatgtttaaaagggaagcagagcataaaagttcagaaaatttgcagcctgaagatgcaatagaaaagaaaaactcattttctgaggagaaattcaatctgactacagaaatttgcatatgtaacgaggagccaaatgttaatcaccaaggcaatgggaaaattgtctccaggaaatgccagaagttttcatggcagcccctcccatcataggaccagaggcctaggaaggcaaaatggtttcctgggccgggcccagagcccccctgctatgtgcagcctagggactaggtgccctgcatcccagccactccagccatggctaaaaggagccaagatagagctcagcccatggctacagagggtgcaagccccaagatttggcagcttccatgtggtgttgagcctgtgggtacacagaagtcaagaactgagctttgggaacttctacctagatttcagaggatatatggaaatgtctagatatccaggcagaagtttgctgcagagatggggccctcagagagaacctctactaggtcagtgcagaagagaaatgtggggttggagcccccacatagagtccccactggggcactgcctagtagagctgtgagaagagggcttgatccaccgtgtgcatggaacagccacagacactcaatgctagcctgtgaaagcagccaggaagggggctgtaccctgcaacgccaaaggagtggagctacccaaggctgtgggagcccaccttgcatcagcgtgacctggatgtgagacacagagtcaaaggagattatcttggagctttaagatttaattactgcctcattggatttgacatgcatggagcctggagcccctttgtttgggccaatttctcccatctggaatgggtgtatttaaccaatgctggtacctccattgtacctagaaagtaactaacttgcttttgattttatggctcctaggcagaagtgacttgccttgtctcagatgagactttggacttggactcctgggttaatgctagagtgagttaagactttgagtgactgttgggaaggcattattgtgttttgaaatgtgaagacgtgccatttgggaggggccagggatgaaatgatatggtttggctatgtccccacccaaatctcattctgaattgtagttcctgtaatccccatgtgtcatgtgagggacccagttggaggtaattgaattacaggggcggttatccccatggtgctgttcttgtgatagtgagttctcatgagatccaatggttttataaggggcttttccccctttgctcagcacttctcctttctgccaccatatgaagaaggatgtgattgcttccccttctggcatggttgtaagttttccctgaggcctccccagccatgtggaactgtgagtcaattaaacctctgtcctttataaattattcagtcttgggcagttctttagagcagcatgagaacagactaatacagactgtatgatcaatatattttactttctgagtttacttattaatgctaaactgtatttttacctttttacttttgaacgccattgtcatattaataagagaatttttttgaccaaagcattttaagttctgtacacttgcagtatttgatctacagatttacacatcatggacagaaatgttatgaaaatcatttacagaattatttaatggaaaacgtttcatatttaatatattttcatatgttgtacatgtaagaaatctgattttatggccattgataagagcgataatggcagccttcatataagatacatttctgtctttttatttttgattatacctgcaagaagacacatggtcctatgcagccaataaatagttgtataataataaagttatgataataaatgtttatacctttcatgttttacatacaccaccaaatgcaaaggaactatgaagcagtttgcactgagaccagttaaaacctaaattctcccctttagctatgcggtgatctatttcctgctacatacaaaatcctgaaaaaatggggctggaagtaattccagtgcttttaaacccaatctacaatttaatttcctttgtgacctttgaaacatcactgttatagaagttccaccattcctaatgccccagatttgccactgttgtttccttattaagaagcaaaacaaagtaaaacaaaaaccttcacataattttgagttctctttcttctcagtaagggaaggattttcacttaacttcacttatctcatttttctgtgttcttcaaccttaaactacatccagccttgttcatgtctctcttaaactttcttctttatacatttcaaaagctttgctctttttctgtcatctaattgggctagatctctattcatattactctttatgttacaacctattaaccaaaatattttcatgtggcaaagaattctgatcatgaggcaaaatgaactaatgagaaaaatttgtcttcatttctagtgaaaactaatttattcttgctttctctagggatatttcaagaattgtacttttggtcttttaggactttgaaaatgttggaattggtagtgaatttctaaccaaaactgtgcataaagtcagctgcttcaaagcaagtcatagaagcctccagcaattctgtgaccaaagaaaagtaaccctaatattaacctttcctttgactttaaagacaataatttgaataatttccaggagacttgaaaaaatcttcacacaaaaataaagttttgttaaatcaatactttgagaaatacccccaaattatttctatattggtgatagtaaaagacaaattcaagtattttatgtcgttcaagaaattggcttgtgtaggattgtgcacgtgacctttaatttccacttctaattttgtcactaactgttatgaatcacacttaaaaaacaaaccatggctatgatctttttaaagctgtaaagcaagactcaataattcacagagctaaccaaaggtgagtacataggaatatcaaaggtatacattagcaaaagattaaacaagtaagtcaataaggaagaaatagaaagacacagccacacaagcctcagaatacaaaagctgatggtgaatcaggatccagaggaatgcaggagtcagaaaagtaacacaaatacgcagaagagtgaccagctggatagggaagtgcagtggcccttgctagggtaataatgcccctccctcacattgccacagatccaggtggagctcacccattatcttgggcctggacactccagggtactctggttgatgtcctacagccggaaactgcatgtcttagcctaaagtctatctttgacgcagaaaaagtagctacaaccacatgcaaaaacaggttggaagtagttgcaagaggaaattaataccctgacaccctgagcggccctttaaaagtgactaacaagagttgaaatataaacacctcagctcctgcaccttgtctaagataactctgagacaagtgttttatgccttcccagactttctccagggaattaagccctagttctcacagtggtgtttggcttgataacatactctttacaggttgctttctcttaactttctcacaactccaacatcctaccacagcttcctagaatcactgcccaaagaaactatttgaactcacatccttgtctcaggatttgcttatgtaagaacccaaactgagacactcataatgcaagaatttatattattaataccagaatcaatccttaagcatggctagtttgacactctacatagaggtaaggaaaagcacttaactggagcagaaaattcactcattcttttgaaaaatgaataaggtactcttttttgtaatagagagtgagtgtaatgggatacagacatacctaatagtagtgttacagtagatagctagtcagatatgagcagggtaggagaccccccacccccgccaccccaaccaggaatgtcaggcaaccatcaagtgatggtcagtcaggtggttattaaactgtgtctttaaaataataattggtcacagccaataccagggaaaggcagtctcccaatagataaaaacacctgaaattggtgatcagcagcttcccgataagatcgcaggagttgggcaaatgggctcccgcgtgcgcactaagaggcaaaatgtcatagtgtaactggtatacgaccttcctctggaaacacttgactggtaagggaacacctcttgaatacaactccagtaaatacaccgtgcatgctcccctcccaagtgtcagcagaccactgtgcatgcagatagccccctaccccaagggaagaattggggagaaggtatataagaccatggaagtatgccaaaatacaaaaccataaatcaaagttcaaacaggacacttaatatctcaagtcgcccacttggcccccttccagatgtactttatttcctttcatttctgctctaaagtttttaaataaactttcattcctgctctaacacttgcctcagtctcttcttctgccttatgcctccttggtcgaattctttcttctgaggaggcatgaattaaggttgctgaagacccgtatggattcactgccagtaacaggaggagagagagttattcaacgaattattatataccgactatatagtaagtgaccttactcattccggctcaccatcacaatatgagtattagggttcaaaggacaagcttttatgaaatgtaaatctcttaatataaagaattaaaataatatccaagtattagattctaaataaatacttttaaaactagttattacaagactgtatctaatcacaaacaggtttttattttgttttgtttttctcactatctcaagctgctgaaacaaatttaatggagtccttccctcatcactgaattctgtagatttttctttcagttgtaagaaaataatgctttccttttgaagatgttggcttggattagaaaaatgctttattatgagtattgcaaagctacttatttaccacagctagacagagactctttcttactttgtcatgcagctgcttgtttttaaacaaattttgccaagagacataaaccagatggtcttcttcaagggtatcctgtgagctgtgatagtcagcttatggtagttttgagcagcagacagctgggtatggaaagtcatgatgctatttggaaatccaactaccaagtgtgctgaagcacaaggagattctcaagtcagtaaataataaaattgtgacttaaagtttgtttcagtattctatttttacagggggcattaactttatgctttataatattacttttctgggtaaaataaaagtaccccaacacattgaattagaaagaaaacttgtgaaaaaatggattcagaatacctttccaagtgggatcaacaaattgtaagttgggctttctaacagagttgtctgtgttttatcaaaaatgtttaattaatactgtaataaaattctactagaatggtgtggtatttcaagttgcaagtctcagttctgttttgtagtagtgttatacacccacactcttgaaatgggttcactaactgccaagtgtatttctctatccctgatctttggatatgccacgtgacttgctttgacaattgactatggatggaagagagaacgctagttataaatctgggtcttaagaaccatcatgtgtttctgcttacccttctgagatctttagaactcagccatggaggaatgtgccccaaatatctactgccattccagcttgagccccagaatgagacacatagatcagacatgtttggtcaacctacagtcagattctgaatcagagattactcaaagtaggcctgtgaatatgaggataagtgcttattgttcttttggggtatgcttgtcacacagcattattgtggttgtagctgactaatattgattgactttggtgagggcccaataaacagctaccttgggtcactcctacattactgagagataggggaaagaaaatgagataaaaataaaagttagcatctacgtccttatcaggatgctactattttatggaaggtacccaaagaaattccagaattatatctctgatgattccaaaattccttcaaaacaaaggacacagactggaccatccttggttttcaagtactatgctataattttgaatattacagaaagacaagtgaaagaactgaagaagaaactaaaaaagcatttcaagacaaacagacaaaatttgcctttttatgaacaaagatagtttaaatttattcaaacatataaattactcaaaggctaagaattttcaaatgtgcatctaaattgtcatttcctacaagtatctagccatactaggaaactacaaagaatattttaaaacttgtatttcaggcagaaatctctcaaaaaaccacatctgtggcttgtaatgggcagttttcccttgagaacactgatattttcaagaggaatttgagactatccacggataaactaaaactaatatgaaaataattcttgtgaaaattgccttacaggcaagaatttgcaactttcatagggtaaacagatttttaaagcgttagaatttcataattgtgacaaacatcctcctagaatagaaggtgaaacaagcaagtaagcagacaagcaagcaagcaaacctttcaccagaatgttatactgactttagtgactaatggatatatttttctctatgagagactgttcatgtatctccaattccctaattagaaaaacatatatccaggtcttagattattttatatattgctgtatccacacctaaaagtcatgatttgaccttagtatagcgaaatgaaaggaaatataaggaaatttaccctgcattaataatttattgaatacactatgatggaaatggagattctgttaaccaaagagtttctcaagaaacttattcattctagaatattacagcttttgagtgagaagcttattatatacatttaagggctcatcaataaaatattaacatgtattgaacatctaacatgaaaccatactgcattccacttaggggtgacaaaaggtatatagtacagcctcttccctgtaggaaaaagtactccactgaatggtaacatgttgcaaacagctatgtaagacatataaactcatgataataacctgtaagataaataggtaaacagagagttctatgaatccagacaatggaataattgatcaagaacagagaaggattccaagaggtggtatttgcactgaatgctgaatggtgtgtaggaatttgctaaggagcaagtcaggactcctcaagcacatcagaaaatcctttaccacttggctttgctaagcatcttgtaatgaattacaatccatttctgctactgatctcgaacataaagatatcaccttcaaaaatttaaacatctttttaaagtactttggtcttgtatatgagactttaaaaagtcattatacgtatttgtgttgtttctactgatgtctatagatctggaaggaagaacataatccttgagcataagaaatcctatgtgaaatgccatggaggcaggctatgtagtggaaaagaattcataactggggtcacgatatagactctggcacatacttcatgtgtgagcttaagacaattatttattctaaaactcaaaattattcgtctctaaaattaaggttctcttgagaatgaaatgatatatgtaaggctctgaacccatgcctggcacataggtgtgcctaaaaataagctcttttatcttatgcaaggtccatcctacgtgtccagaaaaagtaatgtcttgaaatttcagtacattgtcataatatcagctttaaacttaggtccttgttttatagtggttagtcagtgaattagtaagcaaaacttgctaattaaatttaggtaacttatataacttaggatccaactttagtaaaatttaggaaagcattagccctctaagtaggagcgctatgacaaccaaattctccatttctcacatttcctaagcagtagcttaaatctaagtcagacaaaagttgatgaatgagaaattactttgagaatatggagaaacagaagagtaggtacctagggaaatgatgaaaacttctactcttatattggcagaatttagtaagccagagtaagatgcgggctgaatcagagttcataaaattaggaaagaaaaaaaaagggaagggttaactaaagacaaagttgccctttttacactcttcttagggctccttaaataaaacaaaacaaaacaaaacaaaacaggagccgggtgcagtggtgtgcctctgtaatcccatcttctcagaaggctgaggtgggaggattacttcatccagggagtttgagaccagccccagcaacactctcactcaaaaaaaaataaataagtaaaagaaaaataacgctctttttaaatatacatgttgaagactgttagttctcttccaatattctttttttttttttcatgactgaacagtttttagcagagcacatgtgaaataaacacatttcccagccccacttgcagcttagatgtggccatgtgacagacatctggccaatgaagcgtaagtggaaatataacatggcagctcccacgaaacttccctaaaagacaattggtatgcaccctttgacccttcttctggccttcttacatccttcttggaatgtggatgtcatgagagctccatcttgcaacatgtggatgaaattccaccaagtaaagataactcactcagtagaaaacagaaatgagcggggccaacatatctgccttggctgcaaacttccagggtttttcaggagaaagaaataggcttctcttttatttaagtcatttctaccttgagcttctgtaacacttagccaaagcaaattataattgataaaataaagagagtttctgggaaaagtacatttagcacagttttattttacagtaatgtcttttaaaactcatctattccaggtagagaaaaaatgcatatttagagaagggaaatttgtgaaatgacaaaaccaagaaatacacaatgaataaagtcaaatattaatatcagcctccaaaatgaggctagtcctatggacacaaaatttctttctgtattagagtctttttcctttgacaataataaaaatgtttatttagataacaagcaggcaaatacagtcccctcatatactgaagaacaagaatcatctatggtgaggatgaaaatgcttgtatacaactatcctgggaaacaaaaatgttcaattactttgagaaaaagactggggatattgatctatggctaactctgagattatgtgaattttatatctagtcaatttcttatctgaagaaagttttaaactaacctctaagtgaactgtgaagatttataagaatctgaaaatgttgaagatataaggcaaatgatcctggatgaagcggtgatcataaaaagcaaatcactctgcaactcttaagtgctttgaactataaataggaatatgcagaagataagctgatgggcagaaacaaacttctatttaatgcatttcaaaaagctctttcacttaataaatacaacaaattttcttctttaaattctttcaccacctgctcttaacaactaagaattcagaagaaattatatttaaaactaaacaaggaaatgtaaatgaaggctagtttagatatctaatttagacggtatagtgtgctgaatggttcatgttttttaaagagtttcaataagtcacaataagataagaatattattcattgataattggtttgttgtaaggagacgctttgatagtccaatatacattaaatacctcatgacaccaactatatggggttaatcttttgcagtttaaagctttgcctctggtagtaaaacttccatgtaattggcatcaatagtcaaatcacacaattcattttgggttgctgggtggaaacaaaatctcctctatttggctcacaatcactctctcagtggtgtgcaaaatgcaatgactggccagtgaatgatatttacaatagctagggattatcttagattatacagccttcagcagaaacataaacacttgaacagagcagtgtgaaatagaagatagtgtgtgggaggaggcaagctctaatctgaaatatacaagaagaaacttacatatggcaaaaaagacagtatatagaggctacgcttgatggagggagattataataaatgacagattaatgagacttgtttttctcgaagtttatgatggtttatttctggcatacatgccaagttgatgctatcaaattatagtgttcattaccattattatcatcaagtcgtattgattaccaatgtgcactctactgggcattatatatacaagcaaaattcaggtggtttctgacattcaacaaccaataaaataaatcagaccaaagattgtagacatatgtaggagagcgtatagtgcacaagatactcaaatggagaaaaacttaaaggttaaaaataaatttttaaatactttcagtgtttaggtgaactggtaagtgttttggtgtgtcagtttataagaacattgcttgctatatctaagggaactacttattcattattttcttaaaaatgaattctatccaactagttacttagtaaatcatgattttcaaagaagatcttgagggtaaaaaccagaacagaacatttccccataaaccatggtttcaacaattcaaaaaagtgagacggagtggtgcaagatgtcagaatagaagcctatataactaatctccctcactgaaacatcaaattgtaacaactatgagcagacagaaaagcactgtcaccagaaccaaaaaccaggtacggaatcatggtacctggttttaacttcatcttgctaaaagaggcattgaggaaaggcaggagacacagtcttgaatcaccaacaccacaccttcccaatcacccagcactggacgtgcagtgcagagagggaatctttgcacttttggaagggacagtacagctactgggggactttacattgaactaactgctgtgctgtcacagtagagaaaaaagccatgctggcctcagtcagtgcctgtgcacggagggaatatttgaactagccccagccagaagggaatcgcccatcccagcagtcagaactcaagtttcttggcaagcctcaccattgtgggccaaagtgctctggagtcccaggtaaacctgagaggcagtctgggacacacgaactgcaattcctagataacttctagtcatagcctgggctaagagctagaggactagggtggcatgtgacctagggagacaccagctggcatggctaagggagtgcttgcaccattcctcccccacctcaagcagtgcagcccacagtaacaaaagtgactccttacttttgcttaaggagaggagagtgaaaagtaaagaggattctgtcttgcatcttggataccagcttagtcacagtaggatagggcactggacagtgttgtgaggacccatttctaggctcagctcctggacaacactctccaatcaagagagatacagtgtctcgaccaggcatggtggctcacgcctgtaatcctagcactttgggaggccgaagtaggtggatcacttgaggtcaggagttcgagaccagcctggccaacatcatgaaaccccaactctactaaaaatacaaaaattagccacgcgtgattgtgggtgactgtaatctcagcctcttggggggctaaggcacaagaatctcttgaacccaggaggcggaggttgcagcgaactgagatcctgtcacagcactccagcctgggcaacagagtgagatgctgtctcaagaaagaaaagaaaagaaagaaagatagaaaaaaaagagagagaagaaaagaaaagaaaaatagatacagtgtctgaatggatgaaaaaataagacccaattttgtgttgacctcaagaagcactcttcacctataaagctacacacagactggaaataaagggatggaaaaagatattccatgccaatggaaacccaaacatagctggactagctctacttatatcagaccaaatcgatatcaggacaaaaactgtaagaagagacaaagaaggtcattatataatgacaaaagggtcaattcagcaacaggatataacaattatatatgcactcaacactggagtatatatatataaagcaaatatatatacaacactggagtacagatatataaagcaaatattattcgagctcaggagagagaaagacctcaatacaataacagcaggagccttcaacaaccccactttcaacattgggcagatctcccagacagaagctcaaccaaagtagtaacattggacttaatctgcactatagaataaatggatctaatatttacaggacatttaattcaatgagtgtagaatacacattcttcttctcagcacacagattattatcaaagatagaccacacagtaggtcacaaaagcagtcttaaaaattcagtaacaatgaaataatatcaagcatcttctctgaccacaatggaatgagactagaaatcaacaatgaggaattttggaagctatacaaacacatggaagttaaacaatatgctactaaatgaccactgggtctatgaagaaattaagaaggaaattgaaaaatgtcttcaaaaaatgaaagaaaaaccacataccaaaacctatgggatacagcaaaactagtactaagagagaaatttacagctgtaggtgcttctatcaaaaaagaaaaaaacttcaaataaatcacctaacaatgcaacttaaagacctagacaagcaggagcaaatcgaacccaaaattagtggaagaaagaaataataaagatcagagcagaaataaatgactttgtaataaagaaaacatacaaaaagtcaacaaaacgaaaagttggtttattgaaaaggtaaacaaaattgacaaatcttgagccagactaatgaagaaaaaagggagaagacccaaataagtaaaatcagaaatgagaaaggagatattacaattaataccagataaattcaaaggctcattagtggctactatgagcaactatatgccaacaaattgaaaaatctagaggtaatggataaattcctagacacatacaacctaccaagattaaaccataaagaaatccaaaacctgaacggaccagtaacgagtaacacaactgaagccttagtaaactctcccagtaaagaaaagcttgggacccgatggctgcactgctgaactctaccatgtgataaatattgatgcaaaattgatgcaaaaaatattgatgcaaaattgatgcagagtgaacaggcaacctacaaaatgggagaaaattttcgcaacctactcatctgacaaagggctaatatccagaatctacaatgaactcaaacaaacgtacaagaaaaaaacaaacaaccccatcaaaaagtgggtgaaggacatgaacagacacttctcaaaagaagacatttatgcagccaaaaaacacatgaaaaaatgctcaccatcactggccatcagagaactgcaaatcaaaatggattaacgactaaaatctaagacctcaaactaagaaactactacaaggaaacattggagaaactctccaggatatctgtctgggtaaaacaaatcttgagtaatatcctataagcacaggcaacaaaagcaaaaatagacaaatggatcacatcaagttaaaaagctcctccgcagtgaaacaatcaataaagtgaagagacaaccaacagaaagggagaaaatatttgcaaattacccatctcacaagggattaataaccagaatatataaggagttaaaacaactctataggaaaaagtctaataattagatcagaaaatagacaaaagattcgaataggcatttctcaaaagaagacatacaaatggcaaacaggtgtatcaaaatatgctcagcatcactaatcatcacagaaatacaaagcaaaactacaatgggatattctctcaccccaattaaaacgacatatccaaaagacaggcaattacaaatgctggagagagtgtgaagaaaaggggactcctgtacactgttggcaggaatgtaaattagtacaaccaaaatggagaatagtttggaggttcctcagaaactaaaaacagggctaccatatgatccagcaatcccactgctgggtatatatcccaaagaaagcaaatcagtatatcaaagagatatctgtactcccacgtttgttgaagcactgttcataatagccaagatttggaagcaacctgagcgtccatcaagagatgaatggacaaagaaaatgtgatacatatacgtaatagagtactattcagccataaaaagaatgagatcctttcatttgcaacatcatggatggaactggaggtcattgtgttaaatgaaataagccaggcacagaaagacaaacatcacacgttctcatttatttgtggcaggtaaaaatcaaaacaactgaacacttggagatagagggtggaaggatggttaccagaggctgtgaagggtagtgggggggttgagggggaggttgaaatggttacttggtacaaaaaatagttagaaagaatgaacaccacctactatttgctagcacaacagggtgactatagtcaaaacaatttaattgtacatttttaaacaattaaaaaaatacaattttactgtttgtaaaacaaagaataattgcttgaggggatgaacatcccattttccatgatacttgcatgcctatatcaaaacatctcatgtaccccatatatatatatgtaccccacatatatacacatatatatgtgtaacccatatatatatgtaccccacatatatatatatgtaccccacatatatatatgtaccccacatatatatataccccacatatatacactatgtatgtgtgtatatacatagtaaatctatttatatatagtatatgtttatatatagtatatatttatatatgtgtgtttatatatacagtatatatatatatatatacagtatatatatatatatatatatacacactatgtacccacaaacgttaaaaataacatttaaagataaaaaattttgaaaagtggaacataaatagaaatttgtacttctctgtctgtctactgtatcttcttctgcattgtccccatgactgaatccacgggattcctttcttccagtcagtaaaacagtggccatggaataggatatgaacaactttcttaagttcaggacttgcttgttttttaccccttacttcctaattctaccaagctcagaaaccaacagtaagtattttgtattggcacatatacctatacctgggttgtggaatgaagatccagtcttgcataaaaatcttcaaatatggtagagattaattctaagactgcaatgataatccttcgtgagttgtcagcatcctgtatgtgcttatcatgtatcttcccaactacatatggcattgtgacaaatagaagaggctgctaatgctgctatagctgaatgtctcatttaggaacaaacaattctggaaaagctcccagattatgcatctgtccctctagcttccactttaaaagataaaattctatagtgataacgtgaggattagtatactattctttccttatatgggtaatgtgaggttatttccttaccttgacatgaaagaaaattatttattgaatgtctcagtagaaagattacaactgagatagcaaattcttatcagaaactcacattaggaatgggcttgcagaattgcatgctcattccctactgtctgaatacagagacgattagggactttctcttcgaatctgatttatttggtttctactcctgttttctctcctttcgtttctttcattttctcatttttcttcatgtagcacaaatggcagccagagcctgtgagtgctttaatgctgcaggcttactgctatgagaactgaacaatggagaaatccctggggaagcagcttccaactgtcccaccctcagcatcctaatgacctgtggaactgtggttccagaatggtggtgataaatttggaaaatactttctctaaagcagtagtgcccacatatttatctgacaggctgtactgggcaattataaaatgttcaggggtccatggtgaaatgccaaaaatagaacaatgcggtatgcttttcctaaagctacaccttctttattaaaacaattatgatttatgtccctcctgtacttaaagtacatatttattatttttaaaatgtaagtataaattttagttcagtccagcattcacacagaaatgtgtacacatcacaagtgtatggttccataaacttccctaaaggaaacacatcaatgcaagcagcatccacatcaagaaacaaaacattacccagtccctagaagcctgcttcagcccttgttaatcacaactcacaaaggtaactcctatctgacctctaaactccaaagtgcctaattttttagtttcatataatagattcatacagtaagtgttctcttatttctgacttactttatacaacactgtgttcatattttatttttcaacatttcctttattttatgaaatattattaataagaacatttgattaattaaatgcccttatacttctttctctaatttttttagaggtttctttttttgctatagaaatgtaataatatagaaataaatactcttagtctcatgtctattttacatcatatctaaagctcagaaccatcttgaatttaactacttatatgggtgggtaagtcaacccaacatatctgactaagtagaattccaagaaggaaatactgattttaaaacattactttcttgatgtttgacagggaccttgttgttacacaataatgccatcttatggctgtacagcaatttgtagtctagaaactgccttcattttgatgatagcatttgaactgttctaccctcttagtctttgggaagtcattttctaaaagtgggaaacactcactaatggcttacaggatagtaaagatggtatcagaaagaaactaacgacaatagagtataacatctgacatttagtaggcccttcttaagtgttcattgaaagaagaaaagagctttgtttctctaatcccagatagatcttatgtaaattctttgtttttacatgtttcctataggtatattttataagcagttagttacccacccgaaaatcaatgaaaactgaatttagcagtaatattaatttcccaaaaagttaactagtaatcttacatataggcatatctatccatacgttcatggtgcttgtggatttactgttgactgtgttgactgttagtgaacaatcagaatgtccgtgaaaataaggcttttaatactttgatgatgtgtaacttgttgagatacatgttgaaattctatttgctgaaagacaatgtatggaagcaggtatgttagataatgaatgagcagtcataaattagtctggctttttaaatatcttcctgttctcatctaaagcgtaatgtctgttttaccttatgacatttaatagagatgactgaacgagaaatacgcagatgtactatttagtatgtgcttaggcaagtcacataacatctttgaaatatagttttctcccttataaaataatgaagcagggcaaaaccactaaggcattttctagctgtaaaacaatcctgttataaattattaactatctctaataatttgaattatggttcagcaaatattaacatctctccccccttccactgtaggaagagtctactttctcattctattgatgtcagatttggcaacgtaatttgctttggccaatcaaatgtcagtgaacttcacaggagcagaggccatgagtgttcttgggaggtttaggtttatactttggtgactggtcatgaaaacatgtcactgacccttcatcttaggtccagagcaaagacatatatagcagaccttaatccaacatgcatcatggaacctagctctactaacccacatcttgaagcagagcttcccggccaagcccagctgagtcagtcaaggtacaagtaacctaaacagccagaaatgcctgttgttttcagtcagcaagttctagggtgatttgtgtcacagcattattgcggtcatagctaatactaccatacatgtaccatttaagaaaaataccaatatagcccttcttactagctcaaatttattttgatttaacccaaattggcttactaaaaaactcagcagatttttgttgagaacaccacatgaaggctgtactgaacatttgtgtattcaggaatgcatagcttctaaatctctccaaggattcaagaatctaccattgtatgggacttagtaggacacgaggtgttgactgccactacaatgaagaacaaattcagctatttattttccctgatctctggcaataagaacctagttctgtggcctaaacctgtattgtaacagcagtcatcaatctatggcccatcagcaattccagcctgccatctgccttggtaaataaagttttatttaaacacaacatgtccatccatttatatattatacatggtttttttcaccctaaaacagcagagttgagtagttgtgacagagactacatgacctgcagggacaaaaatatcgactaactgcccctttacagaaaaaaatatccatcctctgactatcagatgcttctgccagagaccctagttgtagaatgagcgacacacagcaagaataaataatttagatactttttttttgcagtgacgatagcaagcaatgtccagtgcaatggtgctcctggtaaagcaatggactctggcatgacagcaaaataattcagatttacctcatagcttgatagtagatatattctggatgcctagcctgctcttcctttatagtttctgcccattgttaaacctagctctcaggctttcctattgattccatgaggtatctgatatccttctagtaatttatataattctacctaaagtaactagagtcactttctgttagttgtaactcagaaccttgaatggtctatagaccttgacttattccccattcttagtaagatagcttcattccattccccagggatcttgttcttgccctcttgtacagctccagtctatcaacccttattttactggctggttgtgccttttctctccaagactgtgaagctcttcaaagcagggactgagtctaattcttctctctgtagttctcagggaaatttgaaagcatgtaagaatgaattaacagatatcatgactatcagaaccataagatcaccattttcatcatcaaaattgccaaccttaactgagccattatcgtgtttaagcaacccactaagctccccacatatattgtgtcagataatcctcataacaaccctgtgacatagacactattcttatcctattttatacatcagaaatgtatggagcagaagatttaagagacttgctcaagggcacatagatagcagaaaggccagaattccaaaacgggttggaactctagagcctgtgcttataagcaattacttaaaacagtttgtatctgagattgtactaaaagtcataggaaatttaacagctcctgaccaattcctatagaatgtcaatggaagtacaatttcaacctctggataaggacagggtggatctattggggctagagaaactctatcctttgtcaaaaccagaaaagtcctcagagttggggtgagatttcagcgaccctctctgtggaatggcgttagtgtttctgtttaagtctaaggtgaaggtaaactgaaagggaaatgtccatatgacccagtgagaagggaatacctggatcatttgccaaaaattactcatgagtaaagcggaggagaaacctcaaaaagcagaaagcgttatttctactttagtgcaaaactggtaggtgtatatagaagcacagtaatcactggctatccaagaaacctcaacggtccttaggggatggtgtgggtggcctagaatgcttggagaaaacactgactataagaagacaaaccagagggggaagaacttcccaagagtggaatgaacatcccaaaagatggtaatgaaactgacatcattggagtagcccgcagagcctcataatgtctcaatgtgaaatgctgggagaaagtacaccatggtggcgatataagtttattcaaatatttttgttaatttattttagagagagtctgttactcaggctgtagtacagtggcacaatcatggctcgtggcagccttgaattcctgggctcaagtgaccctcctgcctcagcctcccaaagcacagggattacaggcatgagccaccattttataagtttaagtttgtatttgtagcatatacacagagtggctgagtttctttgcctttatcaagcctggctttggatactgtgggaccagctattttcaaggaagttgagataaatctgtttttttgttttgttttgttttgtttgagacggagccttgctctgtcacccaggctggaatgcagtggtggatttgggctcactgcagcctctgcctcctgggttcaagggattctcctgcctcagcctcccgagtagctgggactacaagcgcatgccaccacgcacaggtcatttttgtatttttaatggagacaaggtttcaccatgttggccaggctggtctcggactcctgacctcaaatgatgtgcccgccttggactcccaaagtgctgggattacagacatgagccaccgcacctgccctggaaggtgcagtgagataaatctggtagactatccaaaggggaaatattctcaggtttcggagaggaggcttgagtccagacacattgaacacccactttgtgctcagcactatatcagtcctgagcatataacacaaataaaacatagcccttttctataaggagcttgtgtgggaggcagaaaagtaaacaaattgattactatgtgttaggttttaggagcaggcacatcagatcatatattctacacggtagccaccaagtctggaaaatttacaaatgcataaatgatttattgatattaaattacattaaatgatgaaacaatatccaagtttccagatgttaggagcgactaatagttttaggatttctagaaaaagacaacatctgaagtgagacctgaagaacaggcaggtcagagggagtacaaaacacttgggcatctgcaaattgatttaatatcgctagaacataattggaggggcttgctatagggcaggcacgaagaaataagcagtgaggctgaccagataattttgcacaattaaggagtcagggtttcattctcaagggaatgagattatagtaccaaagctcttacactttagaaaaatgacggccactgaaagatcgttgagaacaaagtggagataatcacttgagacaactgagattaatgctagaaatctctctttaggtgcctgatgtagtaaaccaagaactaaaataggagtaaagatggttagaaatggacagatgtaagagataccatggaggttccctataattattagacgaatgatttgatttcctctgagaataattaagaagcctaccttgaggataaagacttctgaaatgaatcactttaagctgttagagaactttattacttttaatctaaaaatgtaaaagaaagagtaatccacttcttgtgatgtgaagctaaataatgtaattgaatttctgccaccccccaattaagtcaacagctaaatatttcaattaagataaaaagaaacatgattttaaatcaacttaacaaattccccatggcaaaaaaaaatgtgggggagggtaatgcaaagtgtaaagtgtcaccctccaaaatataaataaatgaaaatcaatttttttattgataggtagtattttaaacatgttaatctaagtatcaaactcctataaatttgtagatacagatttgactaaagataaatatgttatatcgaacaactgtttatagcacctcaatgccccaatctgatttacgattacctgaaattttagaagatataatgcttcaacataacgctaaatttaatactgaataatttctacagttcagctcatttgtctgaattgttcatcattatttgttctcattttacttaccatttttcaatgagagtgatacttctttttccctgtcttttttccatggagggtactgaaataaattctacagttccctgaaaacaaatcatttctgcaagtatcaagaaaaatatatgtgttacctacccttgtcggtccttgtacattttgttaactttttcccattggaaatcaagctgggagagagcttcctgtagcttcaccctttccacaggcgttgcactttgcaatgctgctgtcttcttgctatgaataatgtcaatccgacctgagctttgttgtagactatcttttatattctgtaatataaaaattttaaaacagtaaaaaaatgaattagctgtctatagaaagagaaaaatatatatatatatacaaatcccaaaggtagcaaatggtgttgcaattcttaattattgactttttaaagttaataaccatgaagtccagtgactttgacatgttcaaattcaataggtaaatcacagacctcatcctgagagagtggatcgctccctacatcttaaaactgccttcatttggcttctgtatcctgacctcttctgctttcctttgctggatccttctcatcctgatcttaatattagagtgctctgactcagtatttgcacttcttttcttctctgtccataatccatcccatttgttctcataattttaaatatcttatataagacaatgacacccaaatgtgtatctcaagcccggacatctcctccgaactccagtctaacaaatgctaatttctcaacacttggaggtctcacgagactttcaaacttaatatgacgcaaacaaaattctgaactgcatttcctaatccttctcatcccatagattccctcatttcagtaaatggcaattactgatttcaattgaattatagtaattcaattaacaattactcagattgacaactttggagccatccttaattttttcagtctccagtattcaaattattgggcaaatgttttggcttgactttcaggacatatgcagaatttgactgcttctcactacctttcttgctacagatctgatagaagctattattgtctctcatctgggttatagaactacctatctaaatggtcctcttgcttccgctctttcccccctactggataattctccacacaagagccgaaaagattcttttaaaacataattgggatcatatcactcctctgctcaaaatcttctggtggctcttcatcacagagttcaatcacagccaatttcaaaagcctacatgaaaaataattattcttgcaacactttatacaaataatcaggccaagtataataaagcaaatcagtcctatgatgatccatctttagtaaaaatgggagactggagagagaaaaaaattatgttttaagaactatggtacacctgttattagtctcgtcagctgtttttgagttttttcctgcaatatagactgatcctgcttattcctgtgaacctgccagtgatctctgactgcacctcagaagaaacaagaaggatgggtaatataaaaacctggatcagtattctaattctgggcatgtattggaatcagctagcagccccacatcactttggttccaacagctgcccagttcacggaaagccttctaatttagtttacttgggataattttacttattgtgttttactgttgtggaatatatttgctgttttactttttgtataggaatgcagaataagcttactcaatgttttcttagattgaaaacttactaatcttccagatatcaccatttatcagttatgaatggccctcaccaagctgatgcttgctgactgagctcctctctaccctgaatacaagagaccctaatagttaggcagaaatatcatcacccatattcagcctgaagaagttacagaagatgtattacccttctactacttaatcctaagggtaactctactacccttaggattaagggttcccttgtaaaagaaagaggggaaatatgtcagaggcgttcgaactagaacaactccatcttgaataggggctgggtaaaataaggctgagacctactgggctgcattcccaggaggttgggcattcttagtcacaggatgagataagaggccagaacaagatacgggtcacaaagaccttgctgataaagcaggttgctgtaaataagctagtcaaaacccaccaaaaccaagctggtgaaaaaagtgacctctggtccttctcactgctcattatacactaattataatgcattagcaggctaaaagacactcctagcagtgccatgacaggttacaaatgcatggcaatgtcaagaagttacccaatatggtctaaaatgggagaaaccctcagttctaggaattgctgactccttttcccagaaaactcatgaataatccaccccttgtttagcatataatcaagaaataactacaagtatcctgagtcaagcagcccatgccactgcactgcctacggagtggccattctttattcctttactttcttaataaacttgcttttactttttttaaaaaagcataatcttcactatgacctataaatctctacatgacttggttgtatactacctaccattccaagctcatctcttcccagtctcttcatagtccacaacacttcaccctcattaggtttattgcattacttgagtataacaactacattcttgcttcaagatttctgcccttgctgttctacctgccaaaaatagttttcctaacccacatttctatcagtggttcccttacttctttctcacgttaaaggggccttctctactactctattttaaatagcaccagcaatcactctttattcctggcattactcttcccttttctttatagtacttattactaacattaaaatatatatcaagtagccggtatataccactaatttgaaatctatgactacagggatgttgttatctgttgggcttccaaagctcaaacctgtgcttggcacatgatagatggcaaaagcttttttgttgaataaatgaatagatggtcccataaatttaatccataatgttttgtttatattctatttaacggaaaaatcacaaaccacaaatgggttatacgggaagaaagaaaaatctaaacatatttattctcaataaatttgctaaaaactacattctggctattcttcctagtacgaattttgttattttgatcatctaaattatacataaggtccactgagcaaaatttattgagttcttcccatgtgtaaggagcaatatagcagaaacaaaggtgggtgaaacacagtttagtttgcctttaagaagttttaagtaggttttattgtagtagtaagaaaggatatggtttgaagaattgaagaaaaaaatccaagtatagaagccttagctggatgagaagaaggaagaaatgagtgttccaagtggtaccaaacattttctagaagttagagaaaacatgtatcatatatttggtcataggctcaggaaagaattcacgaagaaggtgcaaattgcagtagacatatctgagtagtagaagtgggaagaacattagagctagtaggtaacacacacgcaaagctaggtaacaagcgcagtcatatttggctgccttttcagtaacatagaagcttaggggaagatggggcatgaaacagaggctgaggatgttcaataatgtgctttgaatctcaacagaaaattctgcctgtacttcagtagctaatggggaactatgatttttaaaaagttatcattatgtaagatttcaaatatatttgaaagtaggaaaataatacaaatagctcccataaccctataatccagtgccaactgttatgactccatggacaatccacccactcacctcttcaactagattattctgaaacaaactgatatattattttctccataaatacttcagcatttttctcttgctgaaatattctctcatgagaacttttttcggaaagtacatatataataccattaacacacctacagtcttaacaaaagttcattaattgaatcaagtatctagttgctattcacatttgagctgaagtgggaaggaagtttaggaaaacagctcagcagaattcagtgactgtgtgttgggtgaagaagaggaagaacttgaatgagtcttaggtatctggcctgggcatccacatgatttgtggtgtcattgggtaacaggatttcagacagatgaagaggttccatggttacatgcttgtgtatgtgtgcataagtgatcagttcaattttggacatggtcattctgaaaagcctttgaggcatcaaactgtagatgttccagaggcagttgaaatcagattttgagaagaggagtaagatggcagggattgctgagccatacatattttcacatttggatacatggactaggctttctgagcaaagagttgtagtaactgtcttaaagggtgactgaatggcaagcgtaccttggagtttagtgcattgctctggagagatttaaaaacttttatctccaagagccctttgattacatttcaacttatattccaaaaataatagacctagatcattggtttatagcccagagcaaagtctctgtcttcctgtatgtctgtctctctcactttctctcctcctgatacatcaggtgctctatataatctccaagatccacaattctgggatttctctcctgtactacaacccctgcactcacagataaacatcttgccctgagatgcttttgagtaattaatgatgtattctctcatccagagatcttatgtttcctgactagataaatataaattttaacaaatatcaacaaagggaatattcttttttttttttttttgagatggagtctagctctgtcacccaggctggagtgcagtggtctgatctaggctcactgcaagctccgcctcccgggtttacttacaccattctcttgcctcagcctcctcccgagtagctgggactataggcgcccaccaccacgcctggctaattttttgtatctttagtagagacggggtttcaccgtgttagccaggatggtctcgatctcctgacctcgtgatccacccgcctcagcctcccaaaacaaagggaatattcttgcctattttcagtcaaaattgggaagcattttaatcatttgtaagttggagactgtgttagatagggagtgactgctgctgatcgtacagctttccagatgacgggctctgaagaaaacttcacaatcagagagggaaacaggaaagaagttaacaataaaacttagaggattttctgccttattctaagatttcacgtttgtggtccacgaggacttgccttgagcaagaactaagctgaagaggcaggtgagactacagataatgtcagttgtaaaaggtaaaagtcaatgcttacaatgggaaccttataaaaagcaactgtgttctcgtgtcttatttatcagctcagcaacaggataagatacaatggttatgggtgatgtgagtgaatttcagagaaagaaggtgtttttaaaataaaatttcaaggcattctcttccagtctatgtacaccttgtgatggaaagctttcattatttcttttgtttcgcacctcaatttaactctgtggaaaaagtacttatctgacaggtcaggtattaccatacaaaagaaagaacaagccaacacagaaacaatctgagaatttacttatctggaggaatgcaggttaaaactgtcttttagcaatttcacatagagaattgatagtcattggaatgtgtgtgatgttgaataagactagggatggtcagattgctcaggaaaggtgtttagggtgaaaagagtgagaagaaaggtagcataaagatgaacctatgtggaaagcatgggcagaggaaggagatgagtatccctaaagaataatagtcatcagacccaggaagagaaccagaaggagggagggagttgtcaacaagtcagatgcagccaggaccaggagggaaaagtcagctcgggcaatttaggaggtcattggtgatcttatcgagagcaacaacagcatgttggaagtggaaaacataaatgtaggcagaccagactgtcttttgctgtcatcatctttcactataaaatagaaaatagctttgtacgacattgcagtatgctgtatttgacatcagaggcttgcttattgaagaaaagtttcatattgataaaaacaaaactcataataaaacagaaactgttggatactatgctcactgcctgggtgatggggtcattcatatcccaaatctcagcatcaaacaatatatccatgtaacaaacctgcacatgtattcctgaatctaaaatacacttgaaattataataaaagagatacaatggatgtaatacctgttattaatgccctaaaagccattgaactcaagcgtatctctagtattatttctttacttttatttacctggtagaattttactaccatcttctgatggctccaagcctggagtcttgggtggaatgtttagggctactccgctagcctgattaggtcaggtaccagaaacgtgcaccaacatatcttcttggctgcttctgttaacttgcctgacctgggcagcctgatttcacaagtacttgattcaactctgaattcttttaagtcactgtctccatcattcttgcttggctgccagtccaatggcaaagatacataactctgccaagtcctccacctgataccaagactccagctgaatgaaaggctgattacttaaattcacattgggcaaccaatcacatttgttagtacatagcaggcccaaaccctttaaatgcatagctgtaagcacccatggagaaaaacattcaagggaagagataaaggatcttccccatcagcatataaaagttatccagttatggctttgatatggtatgcgtgtgtttgtgcgtatgtgtgtgtatgtatactctctgaggatttgagcttgcaaagcttcctgattttaatctgagtctctggggagctaccaattctttggaatgctgtagcattgctcagcatcaagttatgaacggttttagcaatgctgtacagcatgttactaacgcgggaaaactttctatcttaaaggagaaaagcaaaaagcaaaaactggggcaggggatgtcacactccctggatatctagataatagctccttggtgcattctcagagaatgctgtcaaaattggctggagtccaggaaatacatcctttttaaagtccctgcacatattcgtgtcctcaaggcactgcacacagaaaaatggtatgtgcaccaaagaaaatgctgtagcactttccatagtttaaagtcagagatgagatctctgatagtattttactattttagtttgtctagaaataagtgatctttatagtttctgaccctctaaaaaggaagccatagtcccttgtagttgctatggcgatataaacatccctagaatcactatagaatatagcatttctatttctctccctgaatagttccttatcttatctgaaaatatgatgtcaaaatgataaagtaccaactttttagtcaaatcccttcttaattttgacatgcccctatgaattgaccacttcactattccgctgaaattctgtaagatgtttatttttggccactctttctgcaaaaggaaattctaaatatacatacaaatggaattttaatttctgaaaggcatctgtacacgaatttatacaactcgagtccttaatattttaaaataggatatttgcatctctgattcacagtctccaataagttaaagaagaccctgattatgcactgtgaatagagaaaaattagatagcacagtaacttttacaaccggcagatgaaatccagatacctaaagtaaggaaaagcagaaatctataagccatgtggcttcaattcatttatctgtttgaaaagcttattgtttaaataagtgtttattgataatacagacataatatcagcctcaaatgtgagatatgaaaataaagactttaaaatgtgagtctctcccttaagaagataattggtttttaaaggagacacatacagaaataatttgaacataaaaatgctttgtttattcaagtgttgtggagtatgtgtctttaacaggataaaaggagaagccagagaatacagaaaatttatctaggaaacaaacaagggacctatttgccaactaatcagtttaagataaaggtatgaagcaacccttaactatgctccattctttatcataagggatagacttctactgtttagtttttcttccatttaatgtaaagtgacaactactcccttgctgtcaaagattttcattgcagagcctgcctttaccatctaaatggtaaacttatgtgtataaatgtcaaagtagatattgcagaacctgaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcacttataattcacatttttaaccatatttatttcctgaaggaaattcctattcactcacttagtaatagcttccccatttcatctttccctccttggcaggattcagtacagttaggcacagttttcatcatacagacctagccacactagttttaactagtaatactatcttctaggtttctctctctgtgtctgacagctacatcgctgtattcattcattaactcaagaaatatttgttgaaaaaacctaccatgagacagtcatattttatttatttatttatttatttatttatttatttattatttatttatttattttggagacagagtctcactctgtcacccaggctggaatgcagtggcgcaatctctgttcactgcaacctccacctcccaggttcaagcaattctcctgcctcagcctcccgagtagctgggattacaggcgcccgccaccatgcccggctaattttttgtatttttagtagagatcgggttccattacgttggccaggctggtattgaactcctgaccctgtggtcacccgccttggcctcccaaagtgctgggattacaggcgtgagccaccgcgcccagcctgagacagtcatatattatatcttgggtatatactagtgatccagaaagcaaaagccccgctctctggaatctcaccttctacaggagaataaagtaaacaaatagagaaatgactaaactatatactcagttagatagtggttaagtgctgaggagcaaaactaaagcagggaaggaagaaatgaaggataaagtgggggtcagaattttaggtaagaggggtcggggaagaccttaccaggaaggcagtttttaagtaaagatctgaaggaaatgcagaaattaaccattgaaagaaaaatcatgagaataatattccagacaggtaaagcaagtataagggccctgacactggaatgtgcctggaggagtggccaaggaacatggaggaagtgattatggctggagtgtatgagctagcgactaccagagaaatatcagagaatggggtgggtaacccatgaaggtacttatgaacataaggacttccctgtttactttgagggggatggggagcattgggggttttgaacagaagcagaaagggggatataatctgactttccatttaaataggtatctctggctagtatattgacagtagagtctacaggggagaaggcaatgagggggaaacttgttaatagacaactgcaatcatccatgctggagatgatggtgctttggatcagagtggaggcagggttgaattccggatacattgtaaaggcagaatccttaggatttggtggccaattacatgtgtgttggtagagaaaggccttaaggataacatgaagaattttggcacagacaagtggaataatggagttgccattaactatagtgtagaaaactgcaggaggataaggttagggtgtaagattttaacatgctaaatttaagatgtttattatacttctaagtgaatatataaaaggcatatatatatatgtcatgattcaggagaggaatcttgactagagatataaatttgagagtcactaggggtaatttttaatctcttccaaacttgctcagaaaatactgatgttttgctatattccctttccagacctcttttcttccaaacccaaccctgtagacaatcttagccatttctatcacttaaatcaaactttgacacaaaggaattttatttaggggaggtgggaaaggggataagaaaaatgtcaagttgggagcatagattcactgctgctggggcccaacagagaaggcacccagcaggaggagggagttagccctttgatggttgattctgcttaaggctacatcaaggtgttttggggataacagaaatcgaagaagctagaagaaagtacagggaaaaaattcaagtctacaggttggtagacagtcagagactcttggttctgttgccatggtgggattatatacaccttccagaaaacctttccttaaccaatcagagtatttatttaactagatagaaatatgtatcgggaaatccagtccacattttgcactaacacaggaaaatgggtgatctaggatgttgggcatctcctgagtgaactttaataatgagagtcctggtacagctactgaatcaagggtatggtttataaatcggtccagctatgctgaacacaaatatctccttacttattgttttatctctttatttttccttgtgtccaatttatcctgccattttaaggattatccctgaccaaaatccatccatgatgacatatagctttttggacactttcaagcccatcttttagcccatctttttttccaggaaaaaaaagaaaaaactggattcacagtttttatccaacttgatttcctagtgctttgccagcagagacacttgaaaggataatcaaagtgaataacaaagtgaaggattaatctctttgttattcttcagacacatccttctgatacaattttttttttttttacccttactgactttgtatctttaactttgaaaacattttctgcatcaagaaactgtatagcgtagtgcttaagagcagaaactctggagcttgaacatccagagtgggacttcaactatgatatttaaaaatgatctcacctgagcaagtcacttaactgctcaggacctccgtttctccatctgagtatgggtataataatacagccttccttgtagggctgttatgatgaccatacaagttactctaagtgtttagaatgtgtcctggcacaaaaataataactgtcagctattacattcaagattagtccagattccagttatattcacacctcaagctaaggattcctcctctataaaattcctcctagtttctgctttttgtgctgctttcttcttttcatgatttcagttacactcatgtcttatatatttttgcttggatgatgtccttaatgtctttattactctctaacttgtttgtataactataatatgtatattcaataatgttatcaactaccagagtacaaggattattccttaatatttctttcttatcttttagaatgttaagcatagcacttgtagcattaataaatatctgttgacttgaagtaaaaagttgagttgaacttgcttatgaaaatccaatttgaattcaatcattgaacctctaagatttgttactctgttcaaccattgtagatagatattcaggtatggtcagacgtgagctattcaggtaattccttgtttattctactttacttttacaagacattagctgttgaacagtggaatagaagtccacatgcatttcctggctgagtttccttatggtttcctcacagcacattagatatctaagaaaaaagtcctttattcagaattacacctgcccatttctccagatgccacagagcatcaacaagaacaaaaagaacaacaaaaaaaaccctgcactttactgatccaagtgtttctcagataaaatgattctagtccatcagcactaagtaaattgaaaacaattttaccagtccttttatgatacgtacattttgtgttaagttgtacacatcgcctaaatcattttacagaaaatccaaatagaaaaattgactcacatgcatggcaaagggggttttatagaagtaagtacttttctcttagttcaaaatatatggcattctatgatcccaaatttcttagagtcaggatacgctttagtgttgtgtgactcagcagaggagggccaggtaggttttatggaggaaaaattccaaagcaatacaacaatccaagaaaacctcaaaaactgatgatcaccaatgaatggaatatgcttttttaaaattcatgttatactttttaattctatttacatatgcaatcatgagcatcttattattttgataaatgaaaatttagtataaatgattaagcaacttcataggtagctaccatacatgataaaatataatcaaacctgcaaaaattaatattgatgacagtaaactattttggtaaaacagaaaacatatttggtaatattatgcccgttttatatataactaatacttctgatgttggggaaatgtgctttccatcatattgttttacacaggggacagaaaagcaaaatcgctctttcatacaattgttctgtacccaaatgcatacatctaaaaaaaaaaaaaaaagaaagaaaagaaataaacaaaaggcatgatatgggagcaggaagctaacactctactcaatgtttacctttttggaagctccatagatttccttactgataacactatttaatttttgcctgtggtttggcaaattaaatttgggaattggtgtctgttaatcatacgtgatttacaacagaaagttcttgttttttttccatcaggatgtttaatgatatatattaatattcagaaataagcagacttgggtacaagtcattgtattaaactataagatattgccaatatttaaaccttttgaaagacttgacaattcataaggttcaatggaatagcattataattttaatatgttcatggttacaaatttaaccaggagaaaataaatacaaactaacttttttaaatggcaaaggaaagacaacaaaaaataaacaacaaaagcaaatttcaagactccaaagcaaaaaagagaaaaaaacactactgattaaatcattctttgcttagagtttcaatatttttcaataatttttgtcatggttctgaactcacaattagaacaatgggttttaagttactgaactagaaatggaaaaaataaatcaacacatttcataaagaaactaaagcccaaaataaaacaacaattaaaaccaagctagaaaacagcatcctcttcttggtaaaagttatggtacacagaatcttggaataatttagagttgcatttctgcacctcaagataaatatacaataaagtgagttatttgttttataccttaaataaatagaagaataaaaaaattactcctgaataagtaacaactagcctcggaaatacacatggcccccgtcttataatgtttctacttagtgatttttcaactttagggtggtgagaaagtgatatacattcattcgaaaccatacttcagtatagtattcactaaattgaatgagatattcaacactttactataaaataggtcttgtgttctatgactttgcgcaactgtaggttaacataggtgttcagagcatgtttaaggtaagctaggctaaaccatgatatttggtgggttaagtgtattgaatgcatttccgcatacaaaattctcaacttacaatgggtttatctggatataaccccatcacaagtcaaggaacattctgtacaatagaagaatatgatcaaaagtttgtaagatcctctaaggaagattttgtcaaaagcaaacgtggcttagcttgtatgtattctcttattttaaagtttttttagctttagaatatttgccacatctggaaataactttacgtatattttatgtggttaacattttatttacagttttttaagatataaatatgcaattttataatgtttaacacattcttaaaggtaatttgtttttaggatactttacgtggaaatttataactttcttagaatttgggatgtttgatgaagcaatatgcattttacaaatcttgaaatttatataattatacattttaacaggaattttcctacacagtcgtacatgatttcactgtatcttcacaagagtacagttgagtaggcaggggcagttattatcactgatttaatttcaacgttaaaaaacaggcctaaatatcttatgttacttgcccaagggtacaactatcaacaatcaggttaaatctttctaagcttttcaggttccaatacagtactttgctaaactctctactctactgcttatcataaccacataatgaaagctcactgatgtggaaaaatgttagtaatgttttaattatatgtgggttccctgtcacacattttcataaatgattgttttagattcagtatatacaaacctagaacaatttcttcatgcttatatgcatatagatttgtagaatgcacatgtctagatgatttaactcagtgagttaggatacaatataaaaagaagtaaatttggttttctcttttagtaccagcgcttactaacactgccctgtcttcttctatctcagagtccacacctacatgtatcagaccatcactcactaattcaacagatgtacattcagtacctttaagtgctaggtgctgttctaggagttctagatacagtggtggaggaaaaaaacaacaaacaagatactaatttttcttcctggtggctgtgtgtatgtatcaccttcttgaaaaatgtagcactgcagttacatgggttatacatatacttaaatgcatgtatagtgtttatagacttataaaactctaggcactattgtcgtcatattttgggaaggtgaaaataatagctttaagcagttttaggtatcagaaatgccttgagacactttgtaacttggttaacagaggagcacataactttcatttctaagaaaaaaggattagaaaaacccattagtaactgttgtgacagcggccgttggggagtagatctatcttaaaatggaaaaagagaaataagagaaccaaagactcaaactccagttcattttcactctctggaatttgtctttatctgacagataaaggcaacaccctatataaatctaattcttacactcttcacatcccatccagctaccaggcactacattaatgacatatcgaattgggaactgtgttcaatcaaaaggcattaaagtacttattaactaggttttacggagcttccaaaaaaagttaaaaagttatttttggtggctctatggtaaggtgaccttttaattttttcttcatggtttattgtccccatgtgagaaaacactttctaaacacagctacgtatttggaccaaaatattcttcataggatgatgcattgtctttgcataaataacgaatcagtaattatatatcacacataaaaaacgacattataactggtcgaagcacagcttcaaccgtttgtgaataaaaggaaaacctccccacaacttaactgcaacttcaaaatttctaccagcctcatgatttgtaagttttaatatggaagtttctgctttctacactttacacgatggggattatgaaaacagtgctgctgggagaatggaaggagtaggagtgcgttcttaaagtacattttagcagagttgggagtaaattgcagcataatagtcaaggtaggacaactgctaggcttgataaaataatggttggggataaagaatggataatttcctacaagagagatttgtataaaatataaaagaaaactgtaccgaagcacatataaatatgagctgggcatgactgaaaggcagtaaatatctataatctcttctctatagtacaaatcttttcatataatacaaatgaaaaataatgtactatggaaataatttaagcatgatttaaactacagttaatgattaatatttgaaaatacacacatttatatatagcaaatcaatcaaataaatcccaagtcatataagctgttgaagaaacaaattatatttataaccaaataaatgtgttgaaaaactcaatttttctaagagaaaccactgatcacattattgcaaatgtttatgtatagttcaaaagatcagtttctacaaagtcacaatgtattaataaaaatcatcttttccacgcattaaactgttagaactattaaactattagaaaattcaactcgaattcaaaaagcatttgcaaacaaattttgctttgaaattttatatgatccatgattatttagagtaattgcaatgtcctcttattccaatattattaaatacccctgtattacaatatgcatataaacaatgtaatatgcccctgtattacaatacgcatataaacaatcgttcttttattttccttcagatattttgtttggatttctacatatggtgcctcttgctattatctaattctcctaataccagaatagaaaagcagtcactttgctcatggcataattttgccttcatttaactaattgggattattaaatttgtgcttaagagctgtgaaacagattccagaggagaaagatcttaaccagtgtattaaaaatctctgttgccagtacttttgtccctacttcaaggcaagactgaagaatcgaagactaaaatatgagaagaaatcatacatctctcaagggatcttctgctaggttttacgagaccaaagttctaactcagccccaagtcggccgagaatgggttttcatagacacatgcttaagtttctgtatgaccagagaaatatatctgctatctctaatttcaaaatatttccagaatctgacattctctcactaccgaccaagtccaagccaccagcatctctttttcaactcttgttgattctattattggtcccctacagttctactctcaacccagaagccagtgtgatccttttaaaacatgattgagatcatgccactcaactgctcagaaacttacaattgctctcatctcatttagaatcttctttacaatggccccaaaggccctccacaatctggacactcacaactcccatatcctcatctctttctacccttccactggcttgttttgcttcagccactttggccttcttgttggtgcttgattaagataagctcagtcccacatttgggcctctactctatttcctctacacagactccatggctgactcccttaccttcttccaatctttgctcaaaggtcatttctaccctatttgaaatggcaattccgccactttcaattatacctacgtctacccctgtagtggtcctatatccccttaacagattctggtttttttttttttcccaaaatacgtatcacctagtaatacgcaatatttacttatcatttttctttgtttgcttgcttctattctgtctcccaatgttataataaaagctgaatgagggcaaagattcgttagtctttttcactgttttataagcacttagaatagtgtgtggtacatactaagagcttaataactatttttggaatatacgaatccacattccttaggtttacttgtcctaacaattttttgtttctcaagagcaatgcaaaaaacctgaactcaagaggacttgaacgacctggcttcacactatctttggcttataagctcactaccagctttcccttgtggtctcgaacttgaacaagggttgtctctatttcttgatcctatttaaaatctacattaggaccaccatgtctcctacccgtgagctttcttcatatggccacgtttttcatcaccctcttggttacccaaagtatagcacattttattcattccaaacaaggcatctgtactataattggttttgatgagacaactgaaatgatgtgtgcctgatattttttctttccttccatttatttcctccttgtttctctccttattttatttcttttcttcaattctccctccctccttccctcactctctttcttccttacttcctcccttccttcctcctcctttcagtgatttgaaactccagtgcaatgtggaatattgaagggatgtgggcagatatccttgtcttgttcatgttcttcaggtgaagacattctgctctaccataaagaataatattagctgtaaattgattctcattattgcaaaaggtaaagcatagttgtcattcttattataagctatgttcttatttttgtcctaaaaattcacatttattgataccaaggcctaattgaacagctaaggattccctgaatgagggagcagcagaatcacttgaagaattccactccaaaggcatgaactatttctaagaatttctctacgtaaatgctaactacacagtaaatatgtcattatttatttcaaaaatgtcctagatagagttcccctataagcagattcgaagacaagggatgtctttgggaatgatccaaggaggtgctagtaaagtgtgtgtaaggtaggacagggagcaagtgaaatgtatcctatgaggcaggtttttactgtgtgcgatggggtcttaatcctggaacagaattttgggtcagagcataaatcatgcttcagagttaccctaactgaagaatgagtgagtagtggtatttatccaccaaaagttatttgttattggttgaggtttgctggggaacacgggggatgcagaactttaactacctgacactcatgagctttgattactagagagagccctaaggcaaacagtcagagacacttggatctggcagctaccagtcagagtacaaggcatgctgagtcaggaaatgatatgggtgacatcccaagagtgtttcatcctccaataaaactgatgctttcagtaaaattaggcatatggacacatgatgataaatcctttcagttaagtcttttaagtggatcatttctgcttttaggataagctttcaaatatttaactctctccagagaaaaccttttggtaatttaaaacttacgatgctaagaaattctgtgttcatgctttcatatgagatactttaaggcaggatttgacggtttaacacagtaattatattttggaaaattttatcatgaaaatgattttttcttaaaaatgaaatgcaagttaatattgctctaaacttccaaaaaattgcaattcttctaaaattatgtactcttgtctgttatgagtattattaactttgtacatataagcaatcacaatcaattaactgttaatattggctctgaagtaagaaagaaaatattacttatgtgtatgtttctcattcttctctagctctgccttagctagtgtttttgctattaaatgcagatttccacatatgtatatatatatacgtatatatatatgtttgtgtttatctgcatagtctctgtcaacatgattaggtagctttccaattcaatacatctattgaaaccatacgtgctattttagttgtattttgtttagaaagtaattcttttaacatattacatattatttgtgttgtactgcactttcaaaaaagatgtatgttaaagcacagcaatacttactatagttctgtaatttgattcatgcatatctgtcaggaataaaatcaaccacaatttcaaaccttcccaaccagcagctgtacaatttatgcactgcttttccatttttactactggataatgacaatgatgaatgcctttaacaggaaatacatattcactgaaaagactgagctcaaaactatcccccttcaaaaaagtcaatgaaggtaggaagcccattcacctgctggagatttgttgggagacagaaggaatcatgcccacaactgtatcttatggggattcaaccatttagctaaattaaatctacaataataccatattataaaccgcagtaatcaatactattacgattgacatcagctataataatattaaatagatcaggatgaacaaatgattcactgtgagtgtagccaagggtctaacattctgagtatgccaggctaagaggtatggagacagagttattcaatgggcaacttaataagatcagggtcactactctcctgaaccaaatgtccatgaacctgggaaggaatggatattagctcattggcaataatttacttattgaatgacaatgatgcacttacaaactatgctgccatgagaacttagttaatagaaataatgacaggaattctggcatgtcagctttattttattaactgattaggtttcttttcttcattgtaccaataagtgatttgacttttacttcaaacagaataagaaacagtgccacactgacatggatggaatagttccagagatctgtgaagctcttattttactgtgtaattttatagcttatttgatataatgttaagatattaaagtcaagtcactgaagatactgcaacaccgatttccaaaacaaacaaatagctttatccatttgtatattcatacaggcaaatgtgtgatatagaatgagcttccaggaaaccatttgagtataaaatactttagctaatatgtgctgctgatagcaaacccatcttttgcctataatcacatactgtttgcatttgaaaataccaagctctgggtatactataatatttcattttgagtgtaaaatgtacgatcatgaaaattatctggagacacattattatgtgcattttcttgatcctacattcatttatcttcagacactgccttctgaaattcatagcctatttcatcatcattatttgccttacttgagaatttagtaacttgctgttggtggtttgaaaacagctggattttgttggtagcctttaactggcagttataaagaaaatattttattgatttctattcaattttattccatatgttatagcacaggtattgacattaatttgaaattgaatatgtatacataaaaaatataaaacaaaaacaatatacattacatataaatgaaaaatctaatttccctttttggaaaatgaaacagaagtcatccattaactaggaataaactgttcttccatcaaagtttatttactggtggttcctttctgtccctactgcatgtaaaaatgatcatttttgtgcatttcttcattttaggatgtctctcaaagctaaatattgtaaaatacattttctaacttatgtctttctaccctagatttctgaagccaaccacactatcaagtatttttaagaattccatgtgaaagtcaaaatgccatcatgatgcatacaatttaagtcaattgttctggcactatgaatgatcagtatgatcaccttgtaaaatacgaatgaaagtgctttggttttaccttcagagactcctcttgcttaaagagatcttcaaagtccttagcacagaggtcaggagcattgagaagttgttccacttctaatagggcttgtgagacatgagtgatttcagtcaaataagtagaaggcacataagaaatttccaaaggcatgtcttcagtcatcaccatcatcgtttcttcacggacagtgtgctggtatagatatacaaaagaacaattttttttagcttcctaacagtgaaacctcctccattaagtttatataggtctcattctacagctgacaattgaatctacaaactgggctgaaaatggattcaaaacctcacgatggtaagtctagtaaaacggtgatttattaattatatacctactttttccagaaagtgttaaaagcatttcataataagtgacacacacatattagcaccataaatataagacgaaagaccatgaggtcataaggagagtagttttatcctaagaaaaagacgatttttgcaaccggcatttaaatttctaattctaatttgcaactggcatttaaaattctaattttcctggaaatctagatatgggattgggtgagggggactcatatctgttttattcctaacacaggcaactttcctgtatctataggaaagttcactgagatacaacagatacgaagtagttaggctggtatgtaactttgtattaagccctcttctcctccaaattctagacattagctcctgtttttgttgctagtctcttgctaagttaagctgctaatgaagctgctatatgagcagaactgactgcggaatttatattttaaaaagaactccagaatgtcctgatatataagggagcactagcctcttctcttgcacctacacttttctgactgggatccaagtgctagacatgatgagaatttccagctccagagtccttttggagtttcccagtaatacatctttccctattctttataagagcaaaaaataaatactacttggcaggcaaattcagaaagatggatgacctgtgctctcttctgtctacactataggcagcaaaattcttgtaattgaaattattctcccaataactttgtctagaattgatcaactgccacctgcctgttgatgaggtcacctgagggtttcagtggtagggtctctggggaagtacaaacgataagcatgctaacgtagccatttattactgcacagccttttatgacaacaccatacttatttttgcagtaatgtaatacattggactttggggatactagactgaaccccacacaaagaggagtaaaatttacaagctggtcactttatgttttgtttttaatttctctgacctaggattttcatactcaattcttacatgatataaaaaatgaagtaattctaatttagatatctcatctacttgtgatatagcaaattcacagaattgcacaaattagctattaaataattataccttttacaacatttgttttattgtgtatatctgggccaaatccatggcacacattccttcatgttcaatggaataatgtatatatatttctcatttacatttaaaaggatattagaaacttgagccagagtttgataaataaaattcagaatttaacagatttcttaagaaattcttaatttcactatttcatcataagcattttacacatttaaaagaaaaataactcagcaggctatttgaatgtgaaattttcactgacacattaaacagtagaatcaatagcacaagtaacacaagcttgtgttttgcacgcattacattggttggtgaccattatgttgttcttaataaaatttacaagttaataagctcgtctttcttattcacgttagttgctataacccctgcagtaaagatagcttcacatcatctaaagcaagcgtatttcttataatacttatttaatggtgcaattaaatctgcctttaatgatacattttacacctgtaagtttttggaaaacaaaggtttttgttatcaggaacagagtaagtagaagacaagttgtagtttttcatttatttattaatttgttttgttgtttaatcaagggagttgtttcagaattggacatatcttgaaaatatttagaaaaaaatctgggtggccttaacaaaagcagtgggaattcagaaaagttttgatgcatgtcctcatcactttttcttaaaagaaaaataattctaagatgtttttatctattttctgattcttctttgatatgtagttttctcagtcttcattactttcatttgagatgctctcagctatcttaaattcatattggtgcttaataaatatagtaattgtggattatagccagcaagaaacttagctgtatggtcaaatataatgaagaaaaagacactcaaaatatactcacttttgtctgctaacttgtatttaacttccttaaatgaaatttcaaacccaaattttgactattttggtatttgcagaaaggaacgttaaataaaaatgagatttgccaatgaatccaggagctggtcttttgaaaagattaacaaaatagatagaccactagccagactaataaagaagaaaagagaaaagaatcaaagaggcacaataaaaaatgataaaggggatatcaccaccgatcccacagaaatacaaactaccatcagagaatactatcaacacctctacgcaaataaactagaaaatctagaaaaaatggataaattcctggacacatacaccctcccaagactaaaccaggaagaagttgaatccctgaatagaccaataacaagttctgaaattgaggcagtaatagcctacgaaccaaaaaaaaaaaaaaaaaaaaaagcccaggaccagacggattcacagctgaattctaccagagatacaaagaggagctggtaccattccctctaaaactattccaagcaatacaaaagaaaataaattcttccctaactctttttatgaggccagcagcatcctgataccaaaacctggcaaagacacaacaaaaaagaaaatcctcaataaaatactggcaaaccaaatccagtagcacattaaaaagcatatccatcacaatcaagtaggcttcatccctgggatgcaaagctggttcaacatacgcaaatcaataaatgtaacccatcacataaacagaaccaatgaccaaaaaaaccacatgattatctcaatagatgcagaaaaggtcttggataaattcaacaccctttcatgttaaaaacactcaataaactagttattgatgggacaaatctcaaaatattaagagctatttatgacaaacccacagccagtatcatactgaatgggcaaaagctagaagcattccctttgaaaactggcacaagacaaggatgccctctctcaccactcctattcaacatagtattggaagtcctggccagggcaatcaggcaagagaaagaaagaaagatattcaaataggaagagaggaagtcaaattatctctgtttgcagatgacatgattgtatatttagaaaaccccatcgtctcagcccaaaaactctttaagctgataagcaacttcagcaaagtctcaggatacaaaatcaacgtgcaaaaatcacaagcattcctataaaccaataacagacagagagccaaataatgagagaactcccattaaaaattgctacaaagagaataaaatacctaggaatacaacttgcaagggatgtgaagggcctcttcaaggagaactacaaaccactgctcaaggaaataagagaggacccaaacaaatggaaaaacattccatgcttatggaaaggaagaatcaataacatgaaaatggccatagcgcccaaagtaatttatagattcaatgctactcccatcaagctaccattgactttcttcacagaattagaacaaactactttacatttcatatggaaccaaaaaagggcccatatagccaagaaaatcctaagcaagaataacaaagctggaggcatcacgctacctgacttcaaactatactataatgctacagtaaccaaaacagattatactgatagcaaaacagatatatagaccaacggaacagaacagaggcctcagaaatatcaccacacatctacaaccatctgatctttgacaaacctgacaaaaacaagcaatgtggaaaagattccctatttaataaatggtgtcgggaaaactggctggccatatgcagaaaacggaaactagacccctttcttacaccttatacaaaaattaactcatgatggattaaagacttaaacctaagacctgaaaccataaaaactctagaagaaaacctaggcaataccattcaggatacaggcatgggcaaagacttcatgactaaaacaccaaaagcaacagcaacaaaagccaaaattgacaaatgggatctaattaaactgaagagcacagcaaaagaccctatcatgagagtcaacaggcaacctacagaatgagagaaaacttttgcaatctatccatctgacaaagggctattatccagaatctataaggaacttaaacaaatttacaagaaaaaaaagaccccatcagaaagtgggcaaaggatatgaacagacacttcgcaaaagaagacatttacgcggccaacaaacataagaaaaaaacctcatcatcactggtcattagagaaatgcaagtcaaaaccacaacgagatagcatctcacaccagttagaatggcgatcattaaaaagtcaggaaacaactgatgctggagaagatgtggagaaataggaactcttttacactgttggtgggagtgtaaattagttccaccattgtggaagacagtgtgcagattcctcaaggatctagaaccagaaataccatttgacccagcaatcccattactggatatatacccaaaggattataaatcatcctactataaagacacatgcacacgtatgtttattgcagcactgttcacaatagcaaagaattgcaaccaacccaaatgcccaccagtgatagactggataaagaaaattgacacatatacaccatgggacactatgcagccataaaaaagaatgagttcgtgtcctttgcaggaacatggatgaaactagaaaccgtcattctcagcaaactaacacaggaacagaaaaccaaacactgcatgttctcactgataatgggagttgaacaatgaaaacatatggccgcaggggcctgttggcgggtggggggcaaggggagggatagcattaggagaaatacctaatgtagatgacaggttgatgggtgcagcaaaccaccacggaacatgtatacctatgcaacaaacctgcacgttctgtacatgtatcccagaacttaagtataattaaaaaaaaaaagaaaaaatcattcagtgacactggataaaataaaaattagattcacttagaaaataataattcgtgctctcagaccagaattctgtgtctcagcaaataagatccagtgttaatcatagtcctaaaccagggcttaaagaatgtaggcagcacaccataccctggcttctcatctgttaagcttctctccacctgaccccatgtgtctaccatagattattatataccgatttaacaaatattcttcagaacattaaactaaaaaccattttcacctatctttcaaagaaaatctcttttagaagagtgttatgtggcatctatttaaattgccaatttttctggtaatcatccttttactctctgtacaagagttcaatttttaagaaaattttagatacctaagtgacaaataattgtaattctgtatctggttctagaaatcattttttacaaacttttaaataatgaagaagctcttattaacctgatcgaaatactcttaaaagaaatattagccattgaactgcaggttgagaatgctctaataatatgcatattgtgattattttcaagattgtcacaaataagccatagagcaaccagtgtcaatacatggaaataatccctacatgctcagccatggcatgaacacattttctagaacacttagaaatattaaaattcttatggttgaacataatcaataaaaaggtatagtttattactttagaaaaatctgaatgagaaaaatcatttctatcctcaactactgataattaagtaatctttcaaaaatttttctttccattataaagataaattagaatacctgtaatttctaagatgcttctcattacaattacctatgggcaacagttcagctatacgttataaagtctaaaaggttaatgttatactttaaatatatttaatgaagacggatctattgaaagatttactatcttgatacgtagtgtccagtcatcacagataacagacactaagtggtacagatcagctgactagagaaaactaagggttgatcctgtgaactttcttgagaaatagaaatattccaaaataactttttgacaccactgggaaactgtgaactcattttctagaaaattccgtgttattaagtttgaatattctcatttattatagcaatctgatatatacaataatgtttaatatatagacttttttgtaattttcatatacaagaaactaccagaaattgaatcaaaagagaaccagacatttggagatctagtttgctatctattccttaaaagtatagcattcctattgacacagtcatgcgaatctataatgagaaaactacatccattgaatgactttcagtttggtttaataaaaatttcagacagttatttaaaaatcagtgtaattagaaatatcatgttcattttctcttctttatgcaaaatccaggtactcattcagattaatccttttcatttgaatttcattaactctgccttgaataattttatccttctgagttctgatgtgtacaaatcccgtctaaccttttgaaaatcaacttgcttttgttaatgttctttaccaccttatatcattatagatactcatgcatcattagcaaggaaatgctataatctgattaattcattttatttctttgtgtttattttcatttttaaccatatataccccaaagaatatactagcctcattttctagaaacaaaaagatatgtgaaagaaaccataaaatgcctatttttatttaaaaatgaaaagttcgatcaatgcttaatgactattatagaacacaattatgatttgtatgatctaaacttaaagtcaaaacagttttaagattctgagctgtgtaaataggcacaggtatcactcacaaagttttgaatacattttcattcatctgaaacttaagttatcacattcttttcattacataaaatttgtttcttgaagggccataactgcaaaggataaaagcaatcctgttttgaaacaaatggtgcattatgtctaggtttttaaacaaaatgttttcctccatgatttaaaagacttctttctcctttaaatgcattgaggttactggcccatttatgagttatgaggtcaaagaaactcaagaagaaaaatgtgctatatgacatatgattatgacatatgccacaaaataactatatatctcatataaatatggcacatgaaaaatatatcaatgcatcaaaagtgtaacaaaaatagactattatcttgaccaaaaacagtaaaatagtgatggagcctttttttttttaactgcgttggtgttaatgaagatgaaaataagcaaatcctcaaagtaagatttattaatgatttagtgtgagctataatatgaaaatctatgagccataatatgaaagtatgtcagtttgtatctgattatctttcctcaaagggacattcttaaatattatggattatttaaaagtaataacacaatgatatgtaaatccaaaataggactgcaggctttaagtaggttctgatgggtcataaatgaaaaggcaatgggaaagacttaagtcttagacaagtagctctgtctcttagccccacaagtcttcagagaaagacaagtttccttctaggaatcattacagtaataaacaaagttgagagattttttatttatttctcctggacaattataataggcattgtaagcataaaaatgcaaatcacaaacaaattaggcaaaaatattgtattggtccagggtgattaaaaaaccccaaacaataaagcataaaaacaaaacaacatgatgcaggtgagacgggtatggttttaatctgcgttgtcactgttttggatacatataatggcatgacaataacagcattctgacagtacttcgttttgtctgttttagtcaagtcactgggtagaaagatgttgaataatcaatctaatgagtctaagcatattggttatgaccgtgcatagaaaaaatagcaatgagagagtgtttgctcttatgtgatttcccccttcctattgcatcatctaaaaaattgcttatgtgaagctatgtaaccaaaaaaagggcctgtccatctcagaataattattcagaatcaatgaacaatttaccccctttgtttaaaaagaataaaactcactaacatacacaaaatagtcaaggtaaaatatgaaagaaaatcatcctttatgcccatattatttattttctaaagttagaattaatttttaaagcagggcaggctgtcagcgaaaaagatatgcagatgatgctggatttgccagtctttaaatacaccctgcttctagaaggccaggtataaatagtgtcctatgtaaaaggtctggacagacctgctcattgacctgcctcatgtggattctgactttctacaccatgaaatttacctaattcctcagggccaagctcaattactatcaaattaagctgataaactgaatctggaaaatgtgttaatggcttatagtggtttaaagtctttcgtttcaaaggacaacatttgcatttttatacagattttcaaagaattaacataaattagtaacttgataaaattttagtcactaagtatggcctgtgagagaagagaaagaaaagggctttggttgccaccaagataagtatcaacacataagcagcaatatataagcaccaacaatcatggcctgctttgtaaaaccatctccaaaaaataacctataaattaatagataaggttatacaccctagccaacttataaggcagcaaaaaataaatgcagcaaagactcatgcctagtacctagcatacagtatgttatcaaaaatatttgttggataaattaatgaaaaaacaagtatcaacttaacaggataattataagatagatatgtggttacaattgctgggatttacatttataatttatatttaggaatattcagaattcaaacaggaatattttcttcattttataatgcaatctttattgtcatagatttaaaaggtatatctgatttcactatgtcgcatttcttcaattcatagcacattagctacatgctattgtacatgcgtgcttaggtccttaaattgtcttttagttactaatctgactcattatacttgaatacaaacataagcaattatttgaggtaatgacatatagacgatattaagatatactgattttagcttcttcatgggtatcataatgtctattagcaaattgaagggtatgagaagacttgtattcaaaaaatcattttaacctttgataactcttcccaaactcttctcataaaagttttcgtttacatatctagtatatattttttattttaagctattccaaaatttcagcttgggaatacttgctatagcaatctttttgtatgttgacaagcaaatcgaaccctccctccacctcacacacatacttatacttaattcagtgtgaaaataaaagtaacacaagaaaaaataagtatggaaagaccttaaatactgcagttatatttcaccctcctatatcgcttttaacttctgttgccttgtggatctgtcaacttgagtagatttttcagaataaactcacacttttatttctatattacatttgtcacacccctcagaaaatgtggacactatctctagattaatgcggcaactcagtatctatgtctaaatatgcatgtgtcataattatgtttttcaaggaagtattctcttcattagaaatgcgagtgatagtaaagatgcatataattacactatcccgtatggtagtcattagctacacttgacgaaagaaatgtaaatctaaattatttaaaagcaaatacaattaaaaacttagtacatctgtttttactagccatgttttaagttctcagtagcctcaatagctactttattggacagtgtagatatagaacattgccatcatctcagaaagttctataggacagtgctaatctagagaatgacaatacattttatttatagaaaaggttaataccaaagtatgttctgtaatcgttttttattctactcagtctctgtccaaagggctgtctagtacttaatgtggttaaagttacctaatgagcactcaattaatattcttttataatggcaatcatacaagaaagaaagatttgtttctttttcaaattgcttattaaaatataacaatgtgttctattttaaataatgtgaaaactaagattatatgaataattctaatgctggtattatatctatcagaaaatacttgtagcctagttttttcacaaaggtaatttagacaggctactaaatccaaactaaaatgtcacaaggtgaaaactcaactaatttgttattattctatatccaattgattttactgaattgctaatacactgtattttgttttcaggtagacacagcctaaatctgtaagtaatctcactcaactctgaagataattaatttaaaaacctattattgtgaattatacataatttgcattatttatatggtcaaagcttattaattatatatatgcacatgtatgtatgtacgtgtctgtgcaaatacagacacacaaaatagaaatgttgagaatgggtaaatcacatcgtagatatgttttctgtttcactttgaactgagtccatgcaacgtcaagataatcacaactaactgctacaatttagaagaatatatgtatcaggacctcaaattatggaaaaaaaaattgcaggtgaagagagaatgatgatgaactggtgatatttcaaagttatgtgtatcttggcacgatctgagacagaaatgatggatctgatggttttcaagtatatatgtggaatgatctgttggagaccattgatttaaggagatctgtttgacttaagaagggggtcagtacctgctagtttgtttcatgcaggcattactggagagtggctgtactacatggttgaggacagccttacttccaccccttgtccatgagatcagagatgttttcccatatgtaaattttgtgaataggtttcagcttgttaaataattattcatcagatcaaaacaacaacaacaacaacaaaacttccagtatccatgttgcttctcaatcaatcactatgcatcaaaatatcaaaaccttaactgcatttgcgccaagacattttacattctttgacttaggcatgagagaaaataaagcaaaggctttttcagaagacacaaggggctggagagaaagacaaagctgagagtccatacaagtagtatactagaagatacggaaggtacatttaataaaaataaaattagaaacattaaaaggttaacattagagcacagaaagcctgttacctagtttttaaataacaatagacaacttagaaaagagaatgatcatggctaaaaataaaatatgggttctttacagtcaaccagaagaagtatatcacaatttaaagacaaatagaaataaactgacattaatagtgaaaaaataagagacttagagaacagatctaagatacctattaagcaatgataagtaccagaatgagaaaaaagaagagatggaagatttgtaataattaaaacaatcataatagaaaattttccagagctaaagaagttattaatattaattggttatttaaaacgttacccaagtgcaaaaaagaattaaataagtggtgggtcacaactgaaatcccagcactttaggaggctgaggtgagaagattacttgattccaggagttcaagaccagcctgggcaacataatgacacatcatctctacaaacaaatgttttaaaaattagccagtcatggtactgatggcctgtagtcccagccactaaagaggctgaggcaataggatctcctgagcctaggagttggtggctgcagtgagctatgattgcatcgcggcactccagcttgggcaatagcaagaccctgtctcaaaaataaaaacaaaataaaataaaataaaataataaacagggacacatttagaaacatttaaaattatatcttaatgaaatttctgtacttcaatagatgggacagacagcaactttagagtttgagagaaagaaaaaaggttaaatacaaataaatgatacttggactagaatcagactttacactggaaacaatagtagcttgaagatagttgaaacaagaaaacaatggaaactggaagacaattgttcataacctacagagactactaaaaaaagaggagagatattaaagaatgttactatccaataaatccatcatgatgactgcaaagcaaagatcatttcgaaaatgcaaggtttacaaagtttacatcctttatgtttttacgaggacatttctcatgtgttccaaccaaattaaaactgaagtacagttggccctctgtatccatgggttccacatttgtggatttaaccagtcatcgatcgaacacatttgcaaaaatacatggatggctgtgtctgcactgaacatgtacagacatttttattgccattattccctaaacaatactgcataacaactatttacatagcatttacattgtattgggtactataaataatctagagatgatatgaagtgttcaggagggtgtccatagttacatgcaaacactatgccattttatataaataatttgagtattcttgaattttgatatcaaaatgctgaaaccagtgccccacagacactgaaggatgactgtgtaataaagatttcaaaacaatgagaaataaacggtacaaaaaaacagtgacaggaaatacaccttgtgtcgtttgtggtcaaattttatgaagtgatagtgtaatttaagtaataacatgacatcttgaactagtatgtgatactacaagtgaaaacaatagtagccaggaaataaaattataaattatttctttttaaaggattttgcctttgattgaaaataatgaggagttgactaagtaaatcatcttggtgatgagggcattgttcttatttaattttggcgcaacactacagaaatataggcataaaattgttgtttaaaatgggaaacagcactagtaaaatgatagtacaaagtataacttataaataacctataagtgcgggaagagatgcagtagagtgcagtgaagaagatgatgaattataaaattatagacaagggataagagtaaataaaatgataaaataatgaccatcaatatgacaaggaattaaaacagacacagttataagagttattgtaaaaatgaagttggttaaaatgtctcatctaaagatgaactatctatcatttttatatcttcataagatcaagcacgtattggtaagaatatgtgatttttttttatagataccagaggctgggaagagtgtaggtgggcggaatgggtgaagagagattggttactgggtacggacatacagttgcatagaaagagtaagtgctaatgtttgaaagaagagtagggtgactataatcaacaatatattgtatctctcaaaatacctagaagagaggagttgaactatttccaacacatataaatgataaatacttgagatgatggataccctaactatcctgacttaatcattatacattctatgcatgtagcaaaatattacatgtaccctataaagatgtaaaaatatttgcataagttaaaaagacaaaattatctagtttaaaatgcacactccatctataggctgtttacaagaaacataaaaatacaaggtcacaatgctgcgttaatggtgatttagaaaaccattttttaaaaagtgaaagtcacaagaaacataaaaatacaaggtcacaatgctgcgttaatggtgatttagaaaaccattttttaaaaagtgaaagtcaaaataatagcatcaaatgaagtatagttcaagaccgaaaagcactaaatgggtctcagagaaccattgtaatgacaaaaatcacacttcttcccaaagcacagtagtcattaattgctatgccccaaacaattgggtgcattctacataaggtaaaaattactagaaataaaaggagaacatgataaaatcatagctgtagttggtaccttacatacaactcttctgtaatttgttagattaaaatagacaaaaaatacaaataaaaaacaagaatagaggtggtttaaaaccgacaagctaaatttaatccgtattttgtgcacactggaaaaagcatattctcctatttacttgggacatcaaaaattacatagagaggaaacttttaaaagcatcaaaaagaaagatttgataggccaccttttctaatcaaaatataataatccagaaatgtagaagaataatagaatacattttgattcatcatctaagactttcacaaagaatgtataagatctatatacattacctgggaacatgtttctaattgactgttatatttaaaataatacacagaataaagcagtattttttaaaaaagtaaaatatatctatatatactattcattggtaagaatgaacagtatatggaatatagtacaaagagatatctaagactaaactatagactttttaaagactaaattgtagactttttttttgcttcagtgagggaggaatcagcagaatgaagaaatgaagagtagtaaagtttccttaatctacctttgtattaattgattaaagtaatactgcaatacatttaaaataatcgcacagagctctgaactagcactaaagagtagatgcaaatagatacagatttcaaggtaaattgagtctttacataacatatttatcagtaggcatggccccctctaattgactttattgttcataatagacttcacttctattcaagctgcaggaaggcatgtactactaattggctcccaatattatggaagcatagactaagacaaaattcagaagggagaatgaaagcattttgaaacaatttcacatcatcacctaaaaccatattggtgcccctcactgcatacccaattgacagaagagtcgtggcaaagactagtggctgctgttgcccatgaagtaaagagaattatttttaggtgcctgagattcctggagatgaggaaatttaacagccaatggctaatagcactcttatgtgacagcatccaatactcgatatattttaattgatcttaagtactcaattttttttttttttttttttgagacggagtctcgctctgttgcccaggctggagtgcagtggcttgatctcggctcactgcaaactacacttcccaggttcaatttataagcaactaattaaataagtatcactaatgagaaaaatacccaagccaaagtaaacatttagctaaggatattgtaatccataaaaatacaactttttgtttgcatttgaaatgactgcttcaattctccccatgtatttgaagtcactttgctaagctgaaaagttttcctctttggcctggcacattagaccatctttatttccatgcccttaacttgaagggacactaatgacattgtgatatactgataacagtatttacaaaattatctgacctaattccaaataacaagtttgagagttaccctgcattctattcttctttgaaatatgcacaacaatttcatatacctgcaataaaaagcaggcagttaaaaaaacacaactttaggaactcgactaaaagatggagaataacctacaaaaatcataatcttgatgagttcagcaggcatttttttcaaagccaaaggacatattttgctaagtaacttaatagatgtaaatagcaaataacatatagcatagctacataaataagcatatgtgtaacatatatgaatacatttatgtgtgcctatgcagcctcagatgtaaatatagagatataagttagctggtggcagtggtatgtgatttaggaagctaatatgccatatggcattatgtattaaacacttttgcacataggtaagatattaaagatccttgggctgggcgccatggctcacaccagtaatcccagcactttgggaggccgaggcaggcagatcatttgaggtcaggagttcaagacaagcctggacaacatggtgaaaccctgtctgtactaaaaaaataaaaaaattagccaggcgtgatggcggttgcctgtaatcccagcaactctggaggttgaggcaggagaatcacttgaacctgggagacagagggtgcagtgagccgagatcatgccactgcactccagcctgggtgacagggtgagaatctgtctcaaaaaaaaaaaaaaagtatttacctaactatatgaataaactattgaaataattaaattatccataagtataaaatgaaataaacactaattatctgttctctctctctgtctcccttcctccatccctccctctctcatctgtgttgccctgtgctaaattatttccccaaactatgagtccatatatataggttctttttcaccttactcgaggctgcagctattatctcctgtttcagtcatttattccttctgtcccattttgacttcaaagctactaggggcacaaaaaaaaaaagagataattaagtttattagaattacctctttaatcaaagcaaaatttttaaaaaatctccaaaaaaggatttggaaattcatttcataatgaaatataagtaagctttggatttcatgaaccttaaaaaatcaattttgggaatcgagaggccttttgttctactccattcctgactcttggctgtgttgcaggtaaattaaaatgatatccatctgacctctgaataaataaagtgccactgtgtgtatagaaatggttatatttaatattattttcccaaaataatatattttgccaggttataactttgcaaaatatggtaatagtcactgaagaaaaccatttttctcttaccaaagattacgctcaattcttttttaaaagttttgtgaatttaatgacaccttaggcttaatgtgctctactttacaatccagatagtttctcctaaaatagcttgttctctgtcaatgttccaggaaataatagtcattgtattatcctatggcaaggattccaatataaaattgttctattctgtccagaaaatttacaagttttaactctaaaaactcatattgacacaatcaattttcactccattttagatcatatattttgaaaaggtaattaactgagaacttggatatgactgttcctccccacaatctccttgtaaaagcagctacaacagaaataaagtattttaccaaataaaaaataaattttttttcacttctcaaaacttttcagaatacaaatttaattggcttatattatatccagaccaattatttcttaaataataattaactaaaatgatgaacgttagagtcttttgtcaatcacaaataattatgttaattattagtcattatgatcactgggaaataaagaatgtgaaaaaagcatgcataataacattaacgcattttgttaagtttttgatcttgatgcattgtttacaattatgaaaaggacagaaaatgtaatacttctgttttgaattaatttttggattccaaatatcatcaggaaatgatactattatgagttctttatatcaccaaaacaaacaaaaacagattcaaatccagaggatgaaaatatttatacacaagaaaataccattttggtacctttattatttgtaagtgttaacgttgaacaatgttagacaaatgtcgtgataccctaattctactcttttttgtgtattttgtcttgtttttgctcctcacatgtgacaaaataaattcaagaatgttattccagtggataactgttatggggccagtactgcttgccgaacaggccatacatataggaggtgatggttttcatgctttctcttcctcattctgaaacttcaagcaaccaatatagaaacttagcaggaatggtattccttcatgtaaataaatttatctaagttggtggtttacggacattgtatttcataggtcaataacaacattacaaaaaaaaaaaactattagggaacatcacaaaagttctgccctttactttttctagtaaaggacattgtaacaaaatgagaagaaagaaaaagaaaggccattttaatacctccaaaactgttgaaacccataattttgaaagaaaggacaattcttgcattaaaaaactttgctttatgaaaagctaaataaaaaattgctcttttttttcttttccttatggaccattgaaaacttctggaccatggcagactggcattaggataccactgacataaaaatacagaacaaccaactctgaaactgcagggatttccacaggaagatgttatacattcattcattcaatcattcattccacatactttcattaaatacctgctctgtgatagactctatgtcttggggaaacagtgactaacaagatagaataggctcctgacttcatcaagcctacattctaatgatagcagacaaattataaacaagtaaacatgcaaaggtaacatttgcagattgcagtaaatattagaagggaaacgtctagctgatgttctagagcatgatggtaaggatagaatggatgtggcgaacgacataaaataggttgtcgaaggcaggccacctgtggagataatgttcactctgcatcctgcaatgtgacgggagaccagcaaggaaatatccagaaatagaggcccaagtcaaaggaaacataattgcaatgacctgaggtagaagacatcttggcaagtttaaagaagaggagggctttgtagcagattaaagagaccctttcccattagggaggccaatatatgaagaggactagatctcttaattttccacatatgaaatactcgagtgtatctacgaagcaagaaatgaaaatatagtgaccgatattattcatgtttcatgtgtgtttatgattgtctagatactaaccagttaacacattttgagctttatacgggtcacagatggagttatatgttatagataactgtatttgttaggtaattcatttatttttcatcacccagatagtctattaactaagaaagcactaattattatggaaaattatggaccttctggaactttccccagttaatttattctggcgagaagtgcccatgcactgatatccagaaaaacagttaacaatgcctccaaattatctgaacatcttaagtttgtacagatatgggcacttggattatatttaatccatgcatctttcatccatggattagtcaccactaaatatagctttcctctgttttacatgcgttaaaatagctatttaggaattttaaaaactgctcatgattatagcatatggtgctaaatttgagaatgcaatcaattcggacttccatttagttctcttggctgttactaaatgggtgctaaactatactcaaaagattaaataaagggtaaaaatgatagaatgtttttaagcaaaattatgttataacatcaaggctatgtgaatttgtattattcataaaactaaattttaaacaaaccttaattatttcaaaagcaactggatcataaaggagggcaggagaattatcagataacttaccaacttgaaaatattataatccttttattttgtgaaaatcaaagtggaaaacaatatacacttgaatagattttattcatctgttctcagaatatgttccatacaatgagagtcttaagtaatcattgaagaatcagaatgattcacagatggtgcaagtgatttaattatttttaaccagttgttctggacatgctcagaaggatatttccaaccccactgcagaagccatctgagctcccttccagctggtgttccatattttcaaagcaaatttagattggagaaaattacactttatattgttgtgttgcaaacggaggtcaaattgctgtgtataaattcttgttcttttttttcttcattgtatgagttatatttatcaaatatcacgtcttttgtatgattgctatggatttgccaatggtattttacgttttgtgttgtctggcacttaggaggcactagataaatgtttattcaatgaaagaaataccaattcagtgtattcaaaataaaacttgaatttatttctagactcacactaagtgtatggagttaccatttaactgcatcctcaccattattgggaggttcccattaaaaatgaacaaaaaaaggaagaaaccaatgtaataaaacaataccacgatcactacccccatcatcaaagaaaatcatcaacaaaactctgtgttaattcaataagtaaaactacatcttgatgctggaaccctgtcccctaattttataggatcttaggaaacctgcttgacaaattttcacctttttaggctatcataaggataagagataccctttgtaaaaatttagtcttgcatacttcataatgcggaatgactgtaacatcagtcaagaaacataactgatatctgtaatcatttccactatgctaagaaaagggaatggaaggaatatgggcatcccattaatgtccatagtcacaatgagaagtaacaaactgttcccaaatagttctatcaaatgtaataatttttcaaggttgtagcattcaaataaagataatactaactttagtgaaccaagtttcctcatctgatgctaaaaatgagttatatttttttaattttatcagtaacattatatgatagtaaaactgcacatatcaataattcatcacttcattttgtatttatatccaatatttctgaaaaatatattaatcatagattttgcagtcaatatttcctgaagaatgtgctaaatttccacttgatagaaaaatttgacacagtatattactatgttttttcttatgtttattaatatatttgacaacacattgcatgatgactgtagtctattactgtaacattaattcagaagataagcaaatataaaattgtatatctaacagagccataatctaactataaaataattgtgaatagtaagtgtagcttgacacatttattctactatttttatttaacgtgctacttgaagccagtcatttgagacaatattcaagaggtaatatgttgtataaatcacgtataaatggtaaatttgcttaaacttacaagaatattaaactgtaattaacatcttattttatacatagtgatggctttggactagagatattcggaaaacacaaaatcctatgttcatatagtttcttactacccttgatgaattcaattaatgttcttaaacctcagttttctatttggattatttgctttaacttaatagcttgtctttatttttccctctactattcaaaaattgtatacttctatcgatttaatgattagtataaaattcttaacacgcacaagaaattttgcaagttttcattctaagcactaagagaatcttaaaattgctttattcattattgattaattacttattttatgaattaaacaaatatatactgtgtacctagtcactgttttgggtgttgaggacacagcagtgggaaaaaaagacaatttttttttgcattgttgggttggagctctacttctaggtagggaaataaatactcaagaagataaagaaggaaaatattgagaactttcctggtcatgcactttattgagaaaaataaatgaggaaagcatggataaaaagtgtgtgtgtgtgtgtgtgtgtgtgtgtgtggtgtatgtgcacacatgagaaagattcattgaaaaaaacacttttgagtaaagaagttaaggcagaaacgaaaagagccacatggagaaacgggggaggattattttaggcagaggtagcacacaatgcaatgggtgcatgtcagatctgtgaaagcagcagcaaaggggtcaacataggtggagcagaggaaagtattaagagataaggcctgagttaagaagtgggccagccaggtcagatatcccttgaaattcatgaagagttttggatttcacttaaaaatagatgggaattcattgaaggattatgatcagatttaaatatggtttatatttttcaaatgttgtccctgtgtattgtgtagagataggctaaagaaagcatgcgtagatttttttttttctctgaaaatttgaaagaacggtgcttccactgcatttgaggggaaaagaataattttgttttaatcaagtcacgaggctggatgaaaacagcaagacatatatagaataaataaaaatggcaagtgcccaaggactgagcactgaggcatttcagcattagagaagtaggtactacctatggaaactgagaaacaatacatagaaaggtagcaggtaaactggatgaaaaacttaaccaccttctcatgtttcattgatgtccagcatttttctgttttttaatagacactttcatacacggtaaatgtttatttaagacttttccatttttttaccattttctttgcacatcattttcttttgcagcttaaatcttccatcttgtatctttctcctgcttaaagaccaatcttgacgtcctctaaagggaattttatgctagtaaacggtttctgtgtgtctgaaaagatctttatttcaatgttattcctgaaagagagtttctatcagtacacaattctaggttcctacgtggatgttctttcattgtttttgaaaatattattctaccgtcttctggcttctatcattgctctaaaaccaggtaccattttaagtgtcactactttctaaggaaatacagcagtatttaaaattatttctttgctttttttggattcatcagattcatcgtctcatagtgatgatctatacttatatttcttttttttaataatcttttctgcttcagatttgctcagtttcccaatcggagtattggaatttctattaagttttgaaaatcctaagctattatcactacagataatgcctcttctccattgtgggtaggatttatttattcccctttacagctgagggaagcccttgaaaattcagactttaaggaggggttttattttcacctctatattatgtgttgttgaaggtcacatattttgtcctaaaaggtcttgaaaacttcttcctagccattaggctctcaatccaggttcagtttcacgtaagatgatttgatcattcatggcacacagagggaagagaggttccaccatagcccagctgtgtatttaaaacttttaaaaattatattttattcagaatttccacgcatttgaagtgagggggtgaggaattaagtcagtctgtcatctttctggaagctgatactcgctgaacatgcctctacttaaccattaaactgattatgctacacaactagacactagaacaaaaaaactccgtacaaatatttataaccactatgatcatcaacaatctagaaaaacataaaatgttagctaatttcttttttaatccttgtaatatgttaattacaaaattgagctgagaggagaaaaattctacaaacagctacatcctggtgcaacatttcccttaacaaccattattagtcttttgtatttacaattccatttgctaaagaacattctgtctctaaataagaaaatcatttatcttcccaaattctccaaggatgttgcactggcagctgacaatctttgttgttatttcaaggcaaagaagaaaatctatgtggcaattatgcaaagacaatatatttcccctaattttattctcaaaatgagttgcttttattacaagataggagacaatataaaaaatgtgtagcagaccattaaatctaggctcagacattattttacataaggtggtggcaaacagttctgttattacttttcttgtacatctctgcttaaatttaaggaaatcccaaacaacagaagaataatgatacggtgatgttcttcccatttttttctaaagaatattcttatttcaccatcactcaaataagaaacctttcatcaatctgaaatcaaatttcccttttctactgcaactgtctagatgtgaaagtctatagaatctaaccccttcatagaaagtcataatcccattagcatatcaaacgcactagaaagttatagagtaaggaaagtttgcttaatctactgtttaccaaaattgtttaaacactgaaacttttttccttttttattaataactcccaccatgttttggaaagcagtgagttcaagtttggcgtcttccatttctcagatgtatccttggacaaatctcttaacctcatttatgctaatttttcttacagtaaaatgacaaagaaaatgatacttgagagggtcattactgtgatcaaactagatgcatgtgaaaactctttgtgaatgtataatactattcagattcaaacaacttaaaaaagttagtggaaaaatattcacaatatataggtgtttattttacaaatttattcaattaaggactacttttttttcttgaggcggggtctcaatctgttgcccaggctgtagtgcagtggtgtgatccctgctgactgtaacctctgtctcccagtttcaagcaattctcatgcctcagcctctgagaagcttggattacaagcaactgccagcaagcctggctaattttatatataaaacatatataatacatatatataacatatatatataacttgtatatatatgttatatatggatgtatatatgtatatacatgtatatataacatgtatttataacatttatatatacatgttatatatataacatgtgtatgttatatataaaacatgttatatataacgtgtatatgttatataacatgttatatacataacatgtgtatgttatatataaaacattataaaacaaacatgttatatacataacatatacataacatgttatatacataacatatacataatatgtatatataacatataacatgttatatacataacatgtatatataacatgtatatacgtagaacatgtgtatataggcataacatgtatatataaaacgttatatatgtataacatgttatatataacacgtgtatatatgtataacatgttatatataacgtgcatatataacatgttatattcaacgttatatgtgtataacatgttatatataacatgttatacatataacgtgtatatatgtatgttatatataacgtgtatacgtgtatgttatatataacgtgtatatgtgtataacatgttatatataacgtgtatatataacgttatatataacgtgtatatataacgttatatataacgtgtatatataacgttatatataacgtgtgtataacatgttatatataacgtgtgtatacgtacatgttatatatgttatatgtaacatgtgcatacgtgtataacatgttatctgtgtgtgtataacatgtgtatatatgtatagcatgtcatatatatacatgacatgttatatatgttagccaggctgatctggaactcctcctcaagtgatccgcccacctcggcctcacaaagagctgggattacagttgtgagccaccacgcccagccaaggactattttaaataacacatttattgcagcatttaatctacaaacaaggttaattttctatcagccttccaagagcatgtatattttggaaatgtgtactttaattttgtcaaaatatcccattacaattactctgctgtaggacaagctatccattgcaatacaatattgtaaccctcttcatattcatcttttaccacctcacttttatgttccagaagctgtgtctttccttagtatgcctacttctagaagtaaccgtaagagaaactgatgttctgaacgagcagtcttaaactccgaatttgcatacataagtatagggaatataaaacatttataacagaaactactacattacataaccagattatacatcaaagttctactaaatattcattgttcctaaatgaaaggatatctaaataagttatagcacctatgcaaaattctaggtgaaaaatattccattagaaaaatatgttcaaagatactgatatggaaatgaaattggttgtgtttaagtatagaaaagaaacctttaggcctctatgttagcagaagagcaaaaagggagacaaagtgtgagtaacagaagtgataggaaggggctacatcatatagcggatcacaggatttcatttaaagagtaatgggcaggaggggcctgatatgatctcattaactccttagaaggagctctctgccttcaccaggagaaatatggtgtaagtggggaaagactggaagaagaggttagaggttgttgaagtaatccagatgagagataataatcttgtagattagcacttccataacagatacggaggagtgatttgatgcattttgcaggtatatccaacaagagtggaaataatttacatggtaatgtaagagaaaagaatcatgaaggatgtctaggtttctgacttaagtaaataatagtgcaatttaataacatctggagatgttggtagatgccaattaacgtagatggggggtggatcatttatttttcacttggctattgtatgtttgagatgctcattaggcatccaagataagagactgttggatataaaatgttaaacatcaagatcatatacttggtatttgatgtcataacatgctcagctcaagtggaaatgtatttagaaaatggacatttctttttcttcactgaagtgggcttttttttgtatttttttgctgctgttcttggaaaggtcatgtatgtatacatatttcagaggtttagcacttttttgctatctagaaacattataattggtaataatttacatagaacacattatgcacaagccttatatttgttgccattatctcgaataagtcttgtttttatctccctttacatagcatatgtaatatgcaggatatgaattaaggatatgtaattcataggatatgcaataagtcttctatttgatttctctctctttacacaggatcagtcaaacactgcattctcctagtattctgtgttttccttggtggcactgaccaaattttaggattataagcttttttaataaatgttcttatttacagagaaaacaattttatacagctttacatcgctgtctccttccttctagtttcattttattttacacaaatatattgcttagtaattattttagcaaaaatctatagacaagaaattcttagtttttgttcaggtgaaactagctgtatgtctgagaatattttgccttaattcttgaatcatgttttacctggtatttgaaaatgtgcctagcattttgaagatattattcaactgtcttctaatatctattgttgatgaaaagtcttcagtcaatattgtcatcctgtaaatgttcttttgtcttaagtaacccttaatgatacctttttgattactgatgctctgagtttcattcagagctagctggtagacttgtttttattttttccacgttggttgacctttattgaatttgaggattcattaaaatttacatttattccattttattaaatttcattaatatgaaatattgtctcttccccataatccctatttttttcaacttgaaacttatttcacgcagatgtttgagggattaattatattttcatttccagactttgttttttcaaatcttcgttttcactttatataatggcctattcttactggaaaaaaatccatttaatttttatttttgaacattaaaaattacttaatatcctttggtgattatcctcttatctctattttcttcaggtatacattctccttttaacgtttggcatctgataacattgcttataatttttttccacaataatcataattttagtttgtaagcttatgttccttagcagtttcacatgacccttgggggttgtagtggtatcttcattgtataattttgtgtttgcaaatgcctgggctctctgaggttattttccaaatgctacaatgatgtgaggggcagtttagggaaaatcatgccctttcttggcagtcatcagatttgtgtgatatttcctgtgtttattctgtgaatctagagaaaagtatctgcttatatattatagaattaaatttgaaattttcactgaacgagatatctgttgttaacattttaaacaaatgctgcgtacttaattctcttaatgacttatgaaaatattttaaaaattaaagattatgtctattttccaatgttaatatatatacagaaaggagacgaagaaaactttcatgcattgagcctgcataacgcagcaggtgtttgacaaatattaccttatttaatcctcagaaacatccttatctctattgtacagatgaagtaaatgagactcagtttatccctgatcatacagcactcaaagtcactgggattcatattcaaggctgtttatccaagagttaattttactagaccacactgctgtgatagtacatcctatagaactatcccttttcctcagtttacagtccgtgcttggtcttaactgaggaacctagtttctaaaccaacaggaaatatattagaaatgattggaattcctaattaaggcaggagttctctcattttgaatatctggtaaaatttttacctgcgtcctcccagtctcatgcctctttctttatcatctccaggtttgccctgaggaccacaatttgcagataccctctactatgctttggtctgcattcctgtgtggctgggcgctgcctcatgattgttccctcaaagtctcagtccttttctgagctttattactaccatatatagctctgacatggacagagtcccctaaatgccttaattttacagtggttagcacttctctgagtctttatctgtgagataaggaaaattaatttttcattttaaactcactcagctctcacatactaagcattttaagagtaccgcttactatttcaacatgttgctgtaaagacatgaaagatgaactttaagcctacagtttatatctagaaaaacaaaaagggacagttaggaaaagtaaaaatcaaacaattagagaaggagaatatagggggaggtaagaaattctgaagctatggcatatgctgcatcagagccattgtaaggttatatcaaatactacttttcattaagctgttactgtgactatcacaaatgactctagggcgtaagaattgggaaagataactctaatcagtggccacagtgaaattagttttaaaatgcattgacaattggtcaagtataaagatgtatcttgaatatttctacacccacctgtctatctatctacctaccaacctatatacctacttatcatctatcaattatccctcagttctaattaaaatacgatgccaaatataactgcaatattaaattgattattcttcatacagattgtgattactttattatcatggataattaagagttaacacaaaaatagcccccttcacattctgaattttggatctttaatatataaaacttaagaataaatcgtttatgaggaaaatatatcccagaattttactacaattttttaaaaatatatactggttcacacatgcttcctttatttcaccagtcattattacgttgtacaaatatttgttgagagcctactatgaatagggacataatggcattttaagtaagtggtttatggagatttttgatcctgtgcctatttagccataaagcattagcaacttgattagtttgtaacgaattttaaacctgcatattgggtgtgtcaagacctggggaaaattggaatggagaaatgagttagtagtcagataattcaaagcaaaggactcccccttgaatgatctattaaattgaggtgaaactattttattagaattttctttttgattgccttaatctttcgcttcattttgcatctgcagacacaggcttgctggttagtgtaaggttatttatgacacattacattcataacatctaatatgaaggataataggctgaaacattcagccaggtggaattagacttcacatgcaatacagtttcgctatttctcgtattcttccaattgctcagaataattcacctgctattaaactttagggtattagatttaacagaaaacagtgtatttattaattttcttgaagtattaaaagaagtcacaataatatgcaacatacttcccttatatgcttataaaattaagttatggtaactgcttttgacattttaaaaatatacaccaaattaaatggaactgacactatcacagaagaagttcccaagaagtctcatacatgggctgaaccctatgcagttattatttacatagggcaaaatggttgagtatctgtttgattcatataattcaacctaacttaactataaagacttagtttccagattttgacatcctggttttgtgaggagtactttcttctataattacagatgatgatcattcctcttcatcttacaagtgttaataataggaacaaaaatgtacctgtcagaaaacctctatggtttatacctactacaaataaagaagtgagaccaagctaacaattctgaatcgcctttttaaagagagaaccatacactttccattcagttgtttgaaagaagagcagtcactcctttttgttttggctggtaacatttcagtaataacattatctgatattgttcaatctgcaatcaattagcaaccatcttactaggcatccagttcttttatgggcactgtaacccattaagtagttaaaccaggtgtgaggattaagctattattcttcaagtcaatgagataatggcttatgcaggttgacataagatgtaccatgaaatatttattatttatcatgtatacattaagaaagtaaaatcagcatgggatgatctcaggaaagcaatacatattttttggattagacattgaagtaaagtgaatgtatgataaattgacaaattaacattgccaatgttatgaaaaatgatgtagcaaaaaaaattaagatgtattttcatttttgataaggggttttccctgttatctgttaatttcttgtgtctttaattggcaaaattaagcactagtgttacagaagcccaaagtgagggaaaccactcactttcagaatgtacattagaagtttaaaactgtacccagattttttgtctcttttttttttattagtaggcctctgttaatagagtagtagttgcaaacacatacgtgggtttgccagtaacaactcacaatttgtgcaaagttgagtcttcgaaactgagcaaatttgctctcaatttcccgccagcgcttgctgagctggatctgagttggctccactgccattgcggccccatcctcagacaagccctcagcttgcctacgcactgcattcagctcctctttcttcttctgcaattcccgatcaatttcctattgagcaaaaccaatacagggcccagggcagttagctaaccacatcaaccgacttgcaagcagcaaatacttctctcaaaatttcaaaggctgttgtccctttattgtcatcctttgaagtttacaaatatgaaaggcatgactgtcatcctcgctcaataacccaaatattatttcagttatcctttgaatgcttggttttagatattctaattaagtaaatattgaaattggtctaacattttctttcttctaaattcctctggtgtcttgggatttgaaacaatttggagtgataactcattatttattagggaccgtccacatagaatataatttagagggtaagtgaataagttatttatttcctttttaaaggtttgaggaactcaacagagaatgaagcaaaataaaaagtgtaaaataataacagaaaaaaacatatttagacaatatgcaaataaatctatagagagtgaacactgatgtgtgaagatgctctgatgaaatgaatgggctaacatgagtaagaagtcgtccatataccgataagtcattagttcatctggaacaaagatacacaaagtcaattacaattttaccagaaaacacatcacatttcttaaatcactttacatagtctaaaacattttattcattcaacattacgtcaattgaataacacttaatacaatacatttactgaaaacaacacacaatacaaggaaatgcatcaaatcaaagagaacgttaatagaaacaagaacatcaacattttaaatatgatcttcacaggttaattaaactgtataataaaatctggtattgacattctaaaacaacattacctttattttcctttcatctctgggctcaggtaggctggctaattttttttcaatgtcatccaagcatttcaggagatcatcagcctgcctcttgtactgataccactgatgagaaatttctagagccttttttcttctttgagacctcaaatcctgttcatggtgcagacattattaaaatatcaatatatatgtatagtgcacttctggctgcagttatttatcaaaataatttgcgtccctcatctttttgtacaacttaggttaaaatcatatttaaatgcaaaatatacaaagacataattaaattgcctatgcatgaggcgggacccatgtataggaagctaagaaacctgaataacacacttaaagtattttctcttagcatgttcaaacttgcttaaaaattttgtcacattcaattgactcttaatgagctaactgttgtgtagtttatgtgcaagagtttaatatacgaatacaattgacttaactagatacaaactcacaaacctagtgagtttgtatctgacttaaaataggtaaaattctaaaatgtatatctttagccttggggctcatcaacaaaactttatgtactcaaccaatatacattcatgtttttagaaatgcctacataagagtttcataggccattaatattttatgattagaaatataaagccattttagttgtcttataaactgttccaagctgtatgtgtagaagtgtcaccactgttcgtatattggtgaacataactaataaaaaattatgtgagataaatgcttctccttccaaggcttgcatagccacatttatcttactataccaaatcatgctctaaatgcaaaacaattaactatttgaaaaaagaaaacagcaagtgcatgctttcaaatcaatgtgataagactaatttaataaatcaacaatgggaggaaatcagtcatcatgctctttacaagcacactcaatatcttctgtgattaatagaattactcaaaatgccattttataattcatgggaacataagctctgcatgcagctttcatttctacagaaagtagcaattagggttttattcacaggtttaattcgagcgaaaaaataataaatatcagggaatttctaaaaatttcattccattggaaaattttgaccttctctaaaatatttcataaggaccagaattggaactatttgacaggtttaaaaagttattgaatatgttggtatagattggtttggcgagtagtgttgacgattttgattaatcacttatagcctgtatttgcaagaatgaactacatttcattatctagtttgtttaaaattgggaatttaaaccttgctgtactttatgttttatgttgaattttcaaaccttctgaggagtcagatcgaacgctgcttttttcaaaggtagcaagatacagccacgtgaattagagttgagccatgccttatttgtgacataactcacatctttgccaggagaaagggcttggtggtcatcaatctgaaacatctttcatttcctaagcacaaagtgatgtataatatgtaaaatatttagagatgtcatgtagatttctttagaggaatgccagatgaccattaaacactgctattcagtaggacacacaccatcatacgaccagtgtagatacttctgaaagcttgctcacagttggaagggtgtgagttacatagcgttccgattttctagacacattatggtgtgcttttgcactccctcgaggaagaggccttttctgtttactatatttatcagcagttaccttcagaacacctgctggccaattagactttccttgtggattccttgcaggcacaatattgtgtaattacattctcagcagtgtttatttggttgactatagggggaaaggttttattctcttatttgcatgtagaaagcagactccatctacctgctaggtggatccaccttcataactacatagctcaaaagagtgatttacaaggaaaagctcagcaattaaaagtattagaaaatcagccatgcatgcaaatagtgattattgcaaagcatatacaaaaaaaaagtttcacaaaactttccacatgtctagtctcaagaacttcctagatattattatagaaaaattaagtttatcctgctcttcctgcacaaaccagatgagtcacctggggacttgaagccatacactacactgcttaatatgaaagtagcagttcttattcaagggcactaagattattttttaggattcctacataaatgaaatttgactttgtagatagttgcaaagagtgactttcttaaaggcataataaagttttaaaaataaataaaagaatctagggcttattaaacaagtatcaggttaccaaaaaattggacctaatgcaagcaaaatcaattaagtaaagaaagcaggaataatggatacatgtagatcggttattctggcagttaggcaggtttttttcaatataaagtagctgataaaaataaagcacattagaaaattaaatgtataagtactatgaatgcattcccatctttcaattactacttagaaaaatatgtctttaaaaagccataacttttaagcaacacatcgttcaaaatcaaataccactcaaaaatgttaaataaagcatacacattgaacagaaaaagtgagtttctgatgactaagtctgaagcagattttattaatgcacattatattttaccctatatattaaaaaaaaaccacaggcaaggtatattataattttagctctaataccttgagagcattatgttttgtctgtaacagctgctgttttatctttatttcctctcgctttctctcatctgtgattctttgttgtaagttgtctcctctttgcaacaattcttttacagtaccctcattgtcttcattctgatcaaaaacaacaagtacagtcttcattttggtttttaaaaagctgtacattgttaacagagataataagacatgttatttaaacacacacaaaaatccaatttaaaactttcatggaatgctattataagatactgtgctcatagcctttcttttacatttggtacttgaggtttcaaaataagtttcctcccatctagttgtaaagaacacatttttaggggcacctgtagaaagatgggggagtgtggtacttcatcatgtcagacaagtcatgaattactgtgaaagtattcttttggcttttttagtgtagttctagaaattaaaacattagagaaatgagctaaagttatcatttataatgttaactgatccataaaggaatacagatgtgtatttgtgactgagataacagcaaatctgaaaatattaacacacaactacatgaaaatattttgatttaaatgtacactaattcctatctaataactcctgcttcatttctgaaacctaaatgctcaatattaataggagaaatatcaggatattaataaaaatcatgtgctaagttaccatcaaataatttctaaaatatgtcatatatgcatgttaatttaaatacgatcaaataatactaaaatatggactggaaaatggctttaaacattttcaatgggtattttgttcctttaggctgcaagaacaatatcttaattttctttacttagaaataaaatgttttgaataaatgctggtctaatatagtcgcatatatgaccatgtgatttttcacctttagttttctttctttcaactcagaatgtgaaaactttgtatcaagtagtctcacattgtaatggtactcaaggtacactgatgacataaggaaaacaaataataaatttcaaaagtcacaagtatttgtatgtgtgtattacaattcaaggaattagatgttatatatttaaatctataatgcataaacttcaacacgcaactgaggactgattcattttgtatgggggaaagggattatttttgtcagagactggtcaataatctaaagaaacatacggcataatatagacacattatatacttatcataatatagacacatcatatacttatagtctgtaaaagactttacttattttaaaaggtgttgtaaaagtctgtagcattttctagggctgaggacaaaaacaacaaaaaattaaaaaacccacttcacttctttccctataccagttgagggctctagggcagagttggggtcagcccaagaggtaatcagtactttttttcatcttggtgccctctagtttcttctttgacctgaagtagagattgctgtaactcagcaacttggaaagcctcttccgtctttccacaagctgagttggcaaggccaccaaaccccatacatggggagtattgattgaggcagctccaggaagtgggaactaagattggtgggaatagttctcctattgcttcacacacttattacctaaaatttatatattgtcttctgatgtcactttcaagcattgtctgagaaggctctagcactggtaattgtaaaggttaagaatgccacagaggtgatggcagtgaaagaggggaaaaaattgtgaaaaggaggatgaagagagaaaaaaaaagtcagttaataaggatgtgatgtacaaatattcaagccagagagaaatgtagtagatactttgaaattagttgggattgaaggagaatattctgaggttgggaagagcacacatggtcatatttctttactcccatgaaataagcagcatgaatttatacacattttagacatataatgtactaactaaacaactatttggtaaaacaactttgtgggaaattgtaataaataatgttcatattatgcattattctctcttcattgaaataaatgttatactaccaaaaacattgctgatacaaaatgtcagtcatctatgatagttgagtattttattaaatttttagtttattttatgattcgactcttttttccaattacattttgcccttgataagttcaaaagtaggtcaggtcaaaagaaaattgctgggctatttattagaaaccgtaagtgctcctatattaccataccatagtaattcagcatttgtaataaaaggccaagaatattctgcatttataaaattcattagaatcataaaatgtgtaatatgtgctctgaaaattcagttggagacttatctaagttctttccaaatatttatttccactcctagttcattcacacttttatcacaaccaatttaccatatctttattgaagtcttcctctttcagattcaccccctgctgaatttcagcctccagtggttcaagcaatttttgtatatctgagttaaactgctccaattccttcaaaggaatggaggcctaaaaaaaaagatagtgctactttaaatcaaaattactttttattagaaacataaaccaaaagaaatacatttattcaacctcctgttgctaaactaatcacatgcattatgtttccatattatgttttatgaagggttttgaaatacaactggaaaagtacctgaggatgcaaataaggagaaacatttcacatcaccagagctgaacatacatgcaagatagtacaattcatcatttggtgatatcaacaacagtcaatttacagatacatttgaatgggctaatttttaatattctaaagtcaaatttgaccttattttaaatattctgatataaatacatttgggtaaatatgtctcatcagaaattgcctcatttatcaagtaacagtaacctcaggtagaaatgcagaattgtcatcttatccttagaaaaactacatggcaatctgctcagatgttttaaatgacatttttagcacagcacaattgacaggcatgctcttctaagacaatgccattagcttgccttaggaacagtttggttggtgatgcaaataaattcaaacgaatgaacctaatatatttcacataaagaatctatgcttttcaaccttgtaaacatcagtttctttacttttgaactgataatgaccagtctaagaaaactttaaaatctcttgactttctaaacaaaacccttgaaaaggagtgataagtgaaaagacatggaaaatcaaatatatattcaaaaaagtgggcaaggtttagttattagattaaaattctgttaataaaatacattgatactctctcaatctttatgctgtatttctttccattaaaacactagaacatattttatatgggatagctcttgaaaacccatagatgacatacagaaatctgattttctttcagagctaaaacattttacttttgtaaaaccaattcaggaatgacccccgtgtcttttgccaagacgattacattcatcaagtttggtccccacctacccttctccagtcacattcccaggaagaggttgaatttttattagatggcaacttctggtgaacaatacggataagtgtagaagaaaaactaaatatctaaaggtaataatctgtcactattgaagaagtgaataatcaaattctattcatgatgacatgattctcatatgcaacatgaataaccacatatcttctaggtacttctacacacccctgaaagatttatgagataattttaagtgacctattacagtaccagtttttaaatcctaatgatcatttgccatttgaaatatcataagttatttgaaccagtatagattggtagtggtacaaacatgcttaaagtttcaatgtctgtattattagcaattacggtacaataaaatcatacactgtttagatgacggtaaaagtaaaaagattaacaacccttagaatcataactatacaattatcaatttggtgatattttatgttattaaatggttgttcacatttgctaatatttaatgaaagcaactatgttctatgtgattttgtgaatacataatgataatgttgaaaataacttttattgtgtacttggatgtcagaagaacataggtctatttacagtcagatttacctgttttattccaactgcttcttctctagctcatctctccatgaatttaacttctattaatttaagatacaattttctacgaatttaacaattttttatgccttccaagtcttcaccctaagctgttatctgacttttgaattcccatctagactctccaatagccagctgaattttcacctgaagtttcacattcctagtatggagcacattatctttcccgcaaactgcttacaatactaacttccctagttctcttaatggaagaccatttctctcagtcattcaggcgtaaaacgtaagtcatgctatttttgaacatctcactctaatgtctaataaatatcaagtaagtgtcaattgacttgctatgatccacttgctttgtattcccagagactccatcgttcctggtccttacacaaaactaaggcaataagctttgaaaagatgtaaaatctcctttcagtcaaaccagttccagcctgtgcccaatgatcagcttactatgtttcaaaaacctttctttcattatgctatttatttgctgaagaacctcctgcatctattgagtataaatagaataaagtccaacctccagcacagtagtcaaggcttctcctaatcttgccccaaagacttgccagccttatgtaagtgttcctaatatagacctttttttgcaggccatttggtgatcttctgttatgcctccttcaatgaccttagaatacttttcatcttctagtgaagaacataaacttctgtatgaaaatgcatagattgaatctgggctctaccatttactagctgagggaacttagacaagttatttatcctcattgaacctcagtttctttataacatggagataagatgaatatctacctcacagggctattactaagatcaaatatgttagaatggtgtctggtatataataaaagcttaataaatgttgactattattttctctcaaacttctatgtgtccatccaatataaatacatgctctataaatcttgggtcttattttgatcctctcaaaatcctaatcatccattggctcaggtcaagcccttcctcctttgaaatctatggttttaaaggataaaatacatgcttattgatataatgagtctttattttaccaagggatttgatgaaatcataacattgtaatggtgaacatggaggattttagattccagtttggtagagttacataatcctgaagaacaaaactacagattaatttatctgcggcaatataaaaagtgatatcacagccttgcatttagtttacagggtgcagttttttttttttaatcaggaattatttggagacagaaaaggcataccacagatacagtcagtggggtgtgttccctagacatcctatggagctgagtttctcatgttcaacctacagtcatttctggtacatagtaaatattcataagtaaatatttcctgaaaaaataaatgaacaaaagactaaaaattgagggccaaaatagacatttcaaggagcttttttagtgacatggaattttaaataacacaatttctatgtagaaatgtcaaaagacctgactggttagcattatatgagtatgtatattaactgctgcccaaatgctaagcaacatgataccaccaggtaaacacaaaaaagggggaagatgtaaaaagagctttgggagagactaccaaaaactgaagtgctaattattcaggcaagataatggaaacttagacttctttagttcaatgtgtagggtctaaattttccaatgaaagactaccgtgcattttgtttaaaaaaattaggaagattaagaatttgagtagttttattttgtgtagtttcaaagtgattaactaaaatcagtgggcaaaaattatttggagcctaaattttaggtttatataagaacaactgatgaggactgcaatttttttaaaaacactgattttcaagtaatgctaaatgtttataagcagagactagatgaggatgtattcagtcacattttaggaacaaaatccttttcacacagacattttcttaaaattttataaccttacagtaagttcttgtctctaaattcaagtagaacttttatagtagtgcagctcaatagaaatataatacatgccatatatgtaattttaaatattctagttgccatagtaaaaaacaaaaaacagataaaattaattttactgatttcactgagatgtccaaattattgtataaactcataatcaatacaaaaatatgaatattttacattttatattctcttcaaaacccacacatattttacacttatttataaatcttaacatggagtagccaaatttctaaagctcagtggccacatgtggttcatgaccaccttattaggcagtatagagctctattaaccattatactcataacattgtaaagaactaatatctcataattactttgaataaaatagtaatgttttgtttataacttgtggtgaatttagattattcttacgtcggtcttattatcttgcattatgtgttctgagtgaaattttcaggcagtcctcggggtataggaaaaattacgggagtgggattgacctgttatttcaggagtttctattctcatttatgtgtatctcagcttgtgttgcactgctttcttatagacaggaatataatattatttggctttcaaagatatatgcttgtctctctaaataaattttccatccttaaagttggcaatatgtcttatactactctattttccagtgaaaacactgccttttattttatacaggaaaaggtgcttattatatcaatcggtagttttagaactacctatatattaatttaatcaaccagtgaccaattttataaccaaaataagtttatcaaaccaattgttttagctatgttattggcaagatagcaccagccatttgacagccatatgattaatagtctttggacacaaagagatgaaaaaaattcattgcttttcttaagagttcactagttcagcattaggctatgcccattctaaaacagaaaacactttcccacccaattaaaattctacatgtcattccttggtcttccctgtctttgtaacttggaattcttatgcaactttataaaggaaacatgtaataagaaagcgtttataatttaacagctcattcttgagtcaccaaattttaaaacacaaagtatatcatgcctgcttttcaattcagaattatgataaattgtctaaaacagttgaaagcaatggctgataaatcatcttaattattgggtaagttacttctattgactttaaaggaaatagatgaccacaaaagaactggaatcacaattaaatcacacaatgttagacagtgcacacaaaataggttttagttatatagaaaataatcaaacaaaagttataatattgcatgagaaagtgtataccaagcataggttttggacacttttaattttttacttaccttttcattttaagagctttagcatgactgtgcagtcatacaaaatacatataaattagaagacagggaagtataataaatggataaatggacacataaagaagagacagagaaaccgagaaagacaacactttgttttccttgattttttaatgtttcaaattgcttaacaactattaattgtgctttgttggattatttaaggattaatgaaatttaaggctttgttgaagttttggcattaaagctgaattttataacaagttaacaaaggataacagactgaagaaaagcaagatcaattacaaactgattcattgtaaattgaaagcattcaaaattactcagatacactttattagttttaaaatgtaagctttccttggttaaatattactttggcatgcacagatacactagcataataacgactgtgtttacacagacagcaagtaaacatttgttaatctggactatggaatcttaataatcatgataaattaccactatattcaaatcacactaaaacctaaattgaaaataaataatccaagtgctacagattggtttaaaattgcttcaaatccatcagtctcctttttccattctgcagctttgaaaatttatttatcattacaatattgatatagaaaaataaagaattcatggaaaccaagatgaaaaatttcaaggacaagtaacacactatagtacagaaaagacagactactgatatgatatgaagagttatttcacatcattctatctgtagaggaaaagaacttacaaaaacaaataagtgtattggaaagatactacatctatgctagaagaaagattatttaaaatatggtttataaacttatttattctattattttaaaattattagagcaaacaagaaaatgtaagaaatattatttttaaattaaataaattgactccaaatagtgacatttcattggttgcattcttttgagaatagataaagtactggtttacctttaatgctttgataataaaaatgtgaaaatgtgactaatttgtgaggctaattagaggatattacccagtagatttcaattgattttgtatggatgaggttaatttcatgcttacacattttaaaactggatgcaaaatatattcgtgggtcaagaatctgcttcctactgtcgaccttttataaagtttaacttagaatattgccctatttcatgattacatgactttttggagtaggaaatgaattaaaagaggaaaacatttaactctaaaatgtatgggggagacagacaaaagtaaaaacataacactttaagcaattttgtattttaaactttcttttcatttacttaggttgttttccagttttatttcttccattcccccttccttcttccatttcttcctccctaccaccttttgttcttgtcatttttaatacaaaaagtataacgaaatcactgtatttgaagtgaaattgggtatgtttatactaacacatagtagaccaacaaaaactactttatgacataaatagaggcagtaaactatgctgagtcagtgtattgaagtggacaaagcaatggactgagatctagtatttgctaaccacactgtctaactgtgagaacttggtcaactcactgacactctcacaacctcctataaatatctgaaagtctctggtccaaagcaaaattgctttacatctactgacactgatcaggggactaattttcctttatcaaaggagaacaatcaagattcaccaaatagctttaattatttcaaatgttatgctaacaagacccagatagttttatcaaatgacactgctcaccaaactcaattacacatctactttaaaaatattttacatggttaccaaagggatttattagcgaagtttcaatggacttaaccttgttatagggataaccaattacacatgtggaaaaaataagctaacataagaattatgttgttaggttcatatttttctgattcattttagtaaaataaaatttgcagatattatacagtttgactagtgatctgttactattacctgaagatattagttgtaaatattacatatttaatgctctacaaattatgcaatatttacaagtcttcatctcagttttcatgtttttatagaaaattttactaaaaatgaatatctatatacctacaatgtacctacaaaaattaaaaaaattaaaatttaaagaatatatatagcaagaatactgttccaattaagatacaatattattttccatcataggtgttaagttataatacgatcagaaagagactgcaaaatatcaatgtatttgcattgataaatctgactacagaaaattaagctttaattaaaaattttcaatccaatacatcttcattggaccttctagatcacatttataaaatgcatcatttatttcccaccgaagtttaggagagccaaaataattaaatcactgcttaattattttccacacatagaaccatattttaagatagattaggcccaatcatgtgtttctttttcttatatattctacattacatgggaaggtcactgactctctcacagcctcctataaacttgtgaaagtctcttatccaaagaatgattacttttatatcttctgacactgaatggaagtaaaaaaaaaaaaaaaaaaaaaaaaaaacttggtaatttacaattattgcagcaatcaaacaatgaatatttaagtatttgatgcccgattgtccaaatctcatattacagttgtaatacatatatatagaaactgctacatgaattttagcagcaattttcaaggcctatatggaaattaaagaacatatgccagatatatcctatagcaaataagtcttagtaaaggatcaaagtcagagaaaataatttcacttttttctggttagtatcaatttcagaataaataatttaacatttcagctccttagaacagtgaagtatatctaaatctctagaaaaatacaatctaagcaaattttatgtagaaattacataatattttgtaaaaagtaaaataattgcctttattaatatgacacacctaaagtttgtttagtcaaaattattttgcagctaagtattacaacaataaaaatataacttgatgcatattttattattgaaattttttttaatttttatttttgagatggaatctcactctgtcgcccaggctggggtgcagtggtgcgatctcggctcactgcaacctccgcctcccgggttcaaacaatttccctcctcagcctcccaagtagctgggattacaggcgcccaccaccatgcccagctaatttttgtatttttagtagagaaggggatttgccatgttggccaggttgatcttcaactcctgacgtcaggtgatctgcctgcagcggcctcccaaagtgttgggattacaggcgtgagccaccgcaccaggcctattattggaatttatatgcagactttcctagtcaatcagagttaaatttggagtcatttttgaattcatcatcttcttgggtccttgtatgtaatgacttaactctaggctacctctaaatatctccgcagcagcagttctctaagcgtggtccctagaccttcagcatcaatctgacctagaaaaatgttagaaatgcaaactcttgtgctccactccagacctagtgagtcagaagctctgagtgtggggcccagcacactggttttaacaattcacccaagtgcatacaaaagatttactgatctagactgaaatttcctttccactcccatagctatccctttttttgaggtcatcagtgtatctcatctagactactgcaatagctcccgaacttcatgtcattattcagtggaattctcctcacaactatcactggactaatttctcaacagtgcatacacagatacacacacacacacacacacacacacacacacacacacagagcacatcaagaactcttcattgcatactgaattaagcatgaatgattagtctggctgtccatgacctcttcacactgtgtctagccataatcttcagccttatcatccacaactaagttttatcttccatgccctctactctgaaaactaaaggaactcactcttcattgaacacactgtatgctcctaagctttctcatatgtttatgccgaattgttacctcctctgtgttgctggagtgactgctaaactcacttaccatgcactcactctcaatctagtatccatgaacacatcttgccctatcatcaaacagtaagctccttgaatccatcgtattttacctagcaatagatccccctcactaccaaacactgttatcggaaaataatatatggttggtgagaattcatcctgattaatcccttttctcaagtcttcactcattagtgcttttagatatacctcaactagcatctctcccaaattgctgactccccttctccaacttggcttctagagggatggagaggggtagaactgtcataattaatatgaataaataatcagtttatttttgtcttcccatgccccttcctatacttttgtctcctatcaccttattttcccgatggtatccacttgccctcagccatgccactatactccgatgccctaaaacagagacagttgagacaaggagtctctcctcattgattctgtcaatttactcagggttctaatattatctctgattgactgttgcaattctgatcctctccattaaaactgccatttcctcacattgatttcacatagattacgaaaaaacacgcttttttcaaagtcattggatactcttaggtaaccttaataaaatgggaaaaggcagcatttttatgtattttaaggggcgtatgtgggacaaacataactccttagtagttcttaaattcatccacttcattatctttaaggctggtctttgtcatgaaaatagcaaagacacgattttctgactccagtcgattacagcagagaccacagaaaatcagcaattctttcatttttttccatcagtttttgtctcaaccccccagattcggccattcaagtgtaatatacgtaacgatggaaatacccattgatattaattatttttaaccatttcatatctatacactgattaatacattttaaatgcatgtttttacatatattacataatttgatcctcattacaatctttagattaaaataaaacaggcatcatctcccttattttgtagctagaaatgaggctctgagaggtaaagaggcatatccaaaatcactaagtagtaatgtgctcagctagtgctcaaagcaggtcttgtgtcttgaagttaaggactttttgctctcaccatactgctccttgctgaggccaaaattaacattacagagagctgcacttggacagtcaagtcctcagccaatctgaactgaggatccctttactcactgctttctgggcttcggaatttcttgtcatgaacagtcctggcaggagacatgggagtaccccactttgtattcttcaccaaatagtaaatctagacaccagtgaattttcagcataagttatttctctattcaagggctctttagagttatgttctaaaggctatactgaaattactgattacaaagagtctatgacctacccgtgttcaatccaaatctactttttttatcaccatagtattttttttccccaggttactcttccatgaaacttagacatagactcaaccatagaaaagccatattctaacctaatattatcctgtataacccctactataaagaaacctgattttgagatcaaaggctaccccctaaaacctccagcacttcagcacttccctactccagagcaaacacacacaagacattaaatgttttcaatttcttattgtaatcaacaaaagattactgaatagccaaattttagaacgagcagggatttatgaactaatctaatttagaaatttcaaaccatgttctatgagcataatttatacttcctgaattcaatcataggaaggagaaagataaaatggcagatatttcccccatctagtaactctattattttccaatttattaatttaattttaaataatatgattttaatattaaatatttaaatttaatactttattttaaataataatattttgggcaggataggttttcttttaaaaattgttagtctattttaacttcctcatcttacaaacaatgaaatggatatgcagaaaaatcacatattctggctactactgaaaaagttaggcctaaatctcaatcttctaaatccactgttttctctggtgagattaccttctaaatctattgttctctctgccgagatcatctcaccattatttgaacatccccatgaagatgaattagtgttaaacatattttatgattatactaagtattcatttctgtttgaaaacatgtatttcttaagcaaggatctttatacccttgtatcttctcaccacaatctctaacacaatggaagctcaatcccattagctgatgcaatgaatatataagcaaagtgtcagatatgctttatttctgtgtttttcatttcatcgtgataatagagcataattatctcttcagagccctaaaatggggtcattgttacactcagttgcctttactaatttagagaaaaacaaatactttgaaaagcaaacatgtgattattttgttaattaacatataattgaaaatctggggccaggcacagtggttcacgcttgtaatcccagcactttgagaggcccaggcaggaggatcacttgaggtcaggagttccagaccagcctggccaacgtggtgaaaccccgtctctgccaaaatacaaaaattagccaggtgtcacggcgcccgcccgtaatcccagctacttgggaggctgaggcaggagaatcacttgattccaggaggcagaggttgcagtgagctgaggttatgccacagcactccagcctgggcaacagagagagtctccaccacacacacacacacaaaataataataataataataataataataaatgaatattcactggaaatttcttatgccttatgtttctagggaaaataaaagaagttcatagagtggatcactttatgcatgatttccagaagtatacttacaaattcatgcagaatgtgaaatgaaaactcacaaacttgtcttggtcacaaacttgtattggctgggtctgtcacatctgtggtggagagcaaattctacccattttttaatatctgtgaaccacaatcttgtaacacaatttatccaaagataataccttattttctcttaaatattctatagcttagtgatttattaaaatgtgcatgtgtgtgtgtctatatcttagtaatgaagtagtagcattttttaaggattgaaataaatctccattcattgtcttgttattacataagccattgatatctttagaagtaaaaacaattgtctttgtaagtaacaatacattctttcaaaactttaatcaattttaagagcctgtcacatttttttgcaggtaataatgactgactcaaatatatatatttgtgacagttaactactaagttctctcatgctgtctctctccatatgtagagaatatagccttttaaaagtcaactatataaggtctctatgtatggagagagagagtacaagagaactaagtagttaactattaaaaataacttgcaatgaattaaggtaaactaacaactttttaatttgggaaggtgaattttgaagggtaactgtgtctcatgcatacaagctaaactatttagaatttatcatgtcacatttcacttattttgaaaactactttaaatatgtactattatataacatgatgagacactgtaatgccttagaaagtgcagcaattgtgaaaccatgctattactggttgcttatatctatcaaaatattttttgaaaatgttctatttttccaggaatcaatacttacctgacatactgcatcatattttctcataaatactccaatgtttttttcatttcagattatttctaacaattatctatatacctaaatacatatattgattttatatacatttttatgtttgaaagcatatcatatatattgaaatttatcaaactacagtatataaatttctaggtaattacttgcatttcaaatcttcccaaagagctgaaattctataacactatatttatacatttttgcaaactacttattaaataagactttctcttcatcaaatcatacacaaatataaagtctatcacgcaaaagttccatattccctggttcttcttaaacagtaatataaataggcatataaaattacaaaaattaggatatgtaagctttgcaatgatttgttttcatggcgtgatcatttcattatagcctaatgaattttgtcacagtgtctacaactagcaaaagcaagttaaacaaacacacttgcacaaccagtaaagaggtaaaaaaacaccctagaccgtgcagaagatgtacaagacctcattttggatatttgatccacattacatacaagcaatattgtatcagtactgcttttggcaaaatttatcggtagtgctttatgttgatggatgacttgtgtgcttttggttttatttatttttttggccttcagcatgctatttgttatttttttctgtaggtgacccctgaaagtacgtatgtaaactgcagcatagaatgcagtcctagaatatctatggcagcaaaagatgagagagaaaaagagacagagagagacagagagagacagagacggggaggagtggcgtttatctcccattataatcagtggtaaaatttccttaaatacattttggcattcattttccttttgaaaaccttgctgtggggtctacttgcccctttcagagtactgcgcaaccttcgcaagagaccatttagcacaagtttccaccttggagtagatcttcctacctttccagtcttaattctgtgtgaaatggctgcaaatcgatggttgagctctgagatttggggctctactaatttcctgcagtggtcaccgcggtttgccatcaagtttgctgcttggtcacgtgtagagtccacctttgggcgtatgtcattcagttctgcctttaaacgctatattccatgagcaagagataggacttgaagttagtaattaatgaaggtcaagatagaaaaagagagccaaacagagcgagtgagcaagtgagcgagaagagtgagaaagagagagagagaaagtaagaaaatgagagcaagcacatgcagaaaatacaaagggagataaaaccacaacttccataaaacaggactaaaatgaaaatgcgtgtgatttcagaaaaatagatcaccgtccttaagtttgatgcatgtctatttaaaatgtttatttagtccgaggaaggacagggatgttttcccaactatgttgttgcaactatcataatatattctatttagtcttattttattatatcgttactgaatttaatagttgtggaatgaactaagtatgtgctcaggaggtcaggtagctgaagaacacttttctattccttcctagcactttcaagttcctctttattacattgagtgtcataagaaaaaaagtgattttctaacacatacgaattttctgtcacatacagaggtactgaggaatgttcttcctgacctgccgggtcacagaggttgaagttaaataactcagaccctattattcaaaaagccttgaaggaaattcaccataagatgacatctctgactatacatcaagggataatgaagagcacaatacagatccacatcaaaataagcttcagacaatggcataaatgtgttttggggatagcctggaatgaatttatagtttttcattaaaggtatatcgtaatctgtggaaaatatcagaggcataaaaataaattgcatagaaagaaacataatttttgagttttctttaaatagtaaacaactaatcaataaatttatcaaacattgcagcaaaacaaaataaaaaatgtttattgaaaagagagctgttaaaattcaactctacctatttaattgggaaaagagacatcatcaaatagaaacaatgtagtgtctataaggtatatttgcgtattacacctctcatacccttttatcggaatcattttttaaagaaaagattaagttccccttgaaaaagaagacagggcatcctaacagtcagttttgagactaaaagaaagaacccaaagcctagtttacatgtagttaaaaatgaaaacctcagctttacataagcccaacattaagactaattaccaagatttggatatggcataggcaaaaaaatcagctgactggatttcaggtgttcattcagatgggctaaatgaatgatagtgtcagattgttctttgtgttagacacaagaatgtagtaccaccattgacaaaggcagaaatttgcaatatgatttcaaaataaatcttggaatatctttctgaacggagtttacattgggtataattaactgagtgatggatttgaacagaaagtcagattacagaactcttcaaaatcattcatttccattcaaagggggaaggaaggaaaaagggaaagataaaggaaggaagaaaggattgttttactcttattaagacgtccttagtatcttttaggacaaagatgattgaagtaactggtgtacaatttggacattacttttcatattttatttgctaccttaagcacgtcttctttttgctggggtttctttttctctgattcatccaaaagtgtgtcagcctgaatgatccactttgtgatgtggtccacattctggtcaaaagtttccatgtgtttctggtattccttaattgtacagagacataccatggcattattggttagacaatattcttaaagaatttttcctatgttctaaaatgtttaaaagacaacaataaagtttcattgagattagttttaagtggtattttcatatagaatattgcgtaaatataaagaaaaatatattaaaatattgttatagatattgaattaagagccagcatatacgtagaattgagaaattttcaaacacagaattgttactggtcacttatgtatctttttctcgtgacagagaagggtgtaaaagcttctagccttttctcttaccaacaaaagatttaaccactcttctgctcgggaggtgacagctatccagttactattcagaagactgagtttatcttccaccaacgtctccttcttgcccaaaactgttttcaaggcctctcctacctctgtgatactcttcaggtgcaccttctgtttctcaatctctttttgagtagcctgtgaaaaggagagcattgaccttcaagtaatgtcttgtagtcttaagatttaatgcttatgaaacggctttctgtatggttactatgattctgcaaggttttaaacctataactatgtattaatgaatcatgaaaaccataccatatatactgaagcttcattgttgggtaactatgaacatatatatgtacataagcataattcatgtcttatttttcattataaatatttaataaacatacatattgttcaactaaatatatttatatttatttaatttatacatgtagtggctaaaggcagatatttgaaaatccatccacaaataagaaactgcccttagaaaattctacagtatggtgctactgtatttctgcagcagggatttttttagccttttagtgccatggatctttttggcatctgttgaagcttaaaaacccattctcataataatgcttttaaatgcataaaacaaaatacataggattttaaatgaaaacaattatactgaaatacaatgtgcaacacattttttaaatatttgtgatgtagtaatacatgttttatttcctaatatgttaattaacaagatctagcatcaggtctttaggataatttcaatgtagtgatgacgagcataactggtatttttaagtatgtacaatgtctggaacacgttataaaagtatctgtcatttctattagtgacaaagtcatgggtatctctattgctggagtttgttgctcacattttaactgaaaaaactgcttacttttggttttaattgaatacaaataaagataaagttttcccccaatccaagttcacagaccttatttctatccacataccctagactaaaatctcctaagagaataccactatttcctaagaggtgatttataaaacatgaaaacaatcacatttaacatgaaaaaagatagagagtagtgatggaaaaagtgatcttagtacaaaggtttactacctgccctgcataaagcccctttcctggtacatggcacggctgacagacaatgtggccactcggcattccactgagtctgtgcctggttctttccctgcctgtctagttagccagctgtgggacattcacagagagctgagccagagcccaacagaccctttttctcctttctcaataaggttaacagatacagagactgtgattggcactcgagttgaaaagctatttgcgagtggagctgatgtcttaatcacagaaagccaaagcaaaacaaaatcattgagaaacagcaataacaggaaagtggagaaagtccagatacaaataatcaattaataaacacacaaggagcagctctgtaatgccagcctacatctaatttcttaagaaaaaaattacagtacaagagtaagaaattaggtataggctggcctcatagagtcactctcaacatgtcttttctatctttataatatacctaagtagtcctgtggctgtctttctgccacgccataaggtcctggtccactcgaaatcacttctcatactttctgttttggttttgcctttggcatcggataaacaggagaaataaatgaggaaacaatgtataaaaatttttatgcaagacaaaaacactgtttcttcaattctaagatatggttttatgtcacattttttcaataaaaacatgcctgaaattaaggtacttaatgccagatgaactcgacagctatcatgcatggggttcttcatatgtaggtgctatttgttgcacacaggtgagcttagcaattcataaaagcaatttcttcatttatcaatcgtaagtgttgcctgagctcctattatatgccagttactactgtagcagaatcatatgtaattctcctcaatatattctgggagattattagaagtctctcatttgggtagatacagaccctttagagcttaacttcagagtagacatagactagattttattccttttaatactttgacttcaaccttttgtagtatacaacctctacaaccatagatgttagccattgttactaggctctgtgggataaaacggtagagaagtccccatccttcaaaaacttatatccaagtatgagtttgtcaaagagatggacatatacgcaaatgagaattatctactttctatattccagtctactggcatctcgctgtagttgatttattcacaaaggtaacccttcacaaagttgaagcttaatttatatttggattactaattatctcttaataagtcttcataaagatgacactatattttagcatcaatgtaaaaagttattgtgtacatagattttgtttcttacatgacaagcaatgcaattaaaggcaatggaattttccaaaactcagaagagatcacaaaagttttgaacttaggggataatgttgcaggtagttcctgggtcacagaaaccattatgtgtcaacatctggccaaattcctccagctaatttaaacaatgtccagtgatgttcagttgatgggaacaaaataggaaatgtggactaatttctagtgccttcttaagttccacaaaattataaattaaaactaaaagatgttcaatttatcaccattatcaacttgtatttgaaaaaagcagtgatatgatggtggtttataactgctaatggtcaaaagtgattcacaggacaatttacactctgtaaaaaaagagacctagagttaaacttttatgtatgctattcaacaataaggaaccagtattcaatcatttgtatacatgctgttttgggttaggaaaaaatattgtgttaatttagtaggccttaaatttttccctcaaatgtgtttttaatcaaagatatgacttaagaaataagacttaaataagacttagcctttaaatactatgctgagcttgctttctggagatctgaaatactaattgaccaatgtatatcaggtgcctaatatccagtctgtactgtgctattcactgccagagatgaggaatgaggtaatctttgcaaacctcactctaatcatgcctacagtgtagctgcagaggaaagcttaaatgcaataaaacaatttgatatcatactagaaaaaaatcacatttttttttggaaacagatgagccatggctggaataagcatgaatgactacaagggaaaggtgacacttgaaggcggagtgtgcatgggatggtttggattgactaaagacaaagtacgaagcaacgagaaggtatgaaagttagaatacaaggctgccatagaggaacagggaattcttactgtaaactaaaagaatacatttgatgaggttgttgacgaaccattttctctggctctaatagtttcccacaacacaagaatgtctgcatcttcagatgtatggagaaccaacctagagctattgccttggccattgtctttatacctgtactcattcctctcaaagggagctccttatttatagggttggcgagatggaaagaaacagctgaaaagatatggcatttcctccttttcaaaagcatccgattctcagcatacatgccttcttctgccttgtgaggtgagaagtggagagggttctagaagatctactcttctgaaggagcaagttcaaattcaatgactaaattcactaaattataactcagacactttaggtttttcagtcatgtagtaatgtgattgctgctaggatcgattttagggctgaagaaaaagcaagattgtgtacactcagttttaacttgacctatgacatgattgtaagtccaccttcaggagattcaagagaaggtgaacgcaaactatatacttggcactaagggtttttatgatagaggggaaaatatctgacataagtaaaatccaattaaactataaattctcacaatgtctaacatattattttccatatgttactttgtaacatttgatagctccagtataaatagtccaaatactaagcactaacttccatgatttcaaacaaatttgctgtctacttcttagccataatttgtaaatgctactctaatttccttattataaaagaatgagtataatgagttaatttcttccagtgaagtcatgccccatgttgatgggaaggatgaagaatacattctgattcattccccatatctacaagtataattgcttgtagaaatttaaaaaggcatgttcggttcagggttcagctatcggctcacttcactgatacagtagcaagatggaaaaaccttctccattggtctctgctgattataccatcagcatttttcattatttttatttaatggtagaacggtaaaaattattggaaaaatcatctggtcctataggaacacctttacaaacatttcccttcaggggtaaagaaatgtagctcacttaacctctattctctcctccacccatttcgtattttcacaagttttccagtaccttccacagattttcttggaatttctcagggacttatattcttaagataacttctctgtctgatctcttttttccaccccctctttttaaacaaattttattatcttaagagtctcctgttctctagagcttatcttcaatcagcaccacatttatttacctacgtaccttaacatcatttccttatagattcctccctttactaggactcaattaaattcagacttattttagctattcctttctcttactcatgttccctgtaatatgaataaaaggctaactaaagcatccataaaaggcatcttgagaagtccccctacccaggtgaattctgcacttagtatttgcaaatattataccatttctgatcacagagaacaggagagggttctttcaccttttagctacgtaacatattcgtggaaagaaaaggaatacattgccatattactgcaattctaagatgtgcatttgtcacattttaaggattcggaaattgagatgtaacatacaattaaggtttaccttgaaagtggtagtgtttttttttttttttttaaattctcagcagctgtaatcatatcaatggtgcatcacacaatctaacatgtcttaaacatgaggaaatgagatgctaattgcttttacagcccccaaaattactctatcatggctagaggtttaggacatattttactattaggctaatgtgacagaataatataatgatacattcaaaaagaacataaagcattaaatagtggattctatagcaatgtgtattgactttttaataacactgtattgtttattaaagaagaatttcatgaaagcagaatgaactgaacagaaataacagctctaactataatgacagtgaatagtgactccaatggcatgtaacagatgttctattttctaagtaacagctgcttgatgcattcattgcaccaagttaatgatctgctagtgttatttcacttcacagataaattactctgctcactttaaaaaaaaaagatacgtaatttttcaggggaatgagagtataacagactttagagtaagtaatagttcttatatttttatagctaagaggaatgatgagttgaggcagttatccagataatctaggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaagatgcattctgagtttttattgagtgatagtcattaaattctaagagtgaactgaaagccaaaggataattgagcaaccaatgtttgttcttcctgaggttaaatattataaaactttgtttccaaaataaacgtgaaaaacacggtaatttgttaaacaagtggctatttagacatagattattctgcatttaacaccttcagttaaatttattaataccatttgtgtgcgtgtgtgtttgtgtgtgttcctctcaggcaactcttggcatactaagactactgttaataaaacaggcggtaggatgaacatactataggaccaaattttttttttccagaaaatcttattctaccatttgaactttcagatgacaccatggatatttaggggtttaatggaactaaattatttaactgagttggaatctttgatgcttaaaacaaaattagaaataaaatgttagtgattaaatcagaaaatcatatagattagactttgtcaaagcttgtatttcccaaacataatgatcttcagggaagtaaacctctaattaatcacatacatatttactttcctatggttatgttttcgtgatcaattcatatgctaaacaatattggccagtaatgggatgttcagattgatttacttacactcaactaatcagagtgatattaagatactaacaaacaatatttgaaatctaaaatcacaacagtggggacagactacagactgtagtaggtgatagatacacacgggttttcattttattattttaatgaggacttatattttctgcacttgaaatttagccatggtttgtttcatgcttattgtgaataagtagctttttgttattttaagcttagattactttaaaattactagaaaataagacttcttatgataatttggtatagtggaaaaaactgttgaaatcaggcatagtattacagttttgctatgtaccaggacttgtatttgttcatctataaaacgggaacatttgatcaggtgattatttatgtttgttataaaacttgtacaattttaaatgtaaatcagcatttttctcttctctcaagaactgctttgtcattataatttgcaactcttaatttgcaagttacgtttaaacagatatttcatgagtatgtcctatgtgtcaggcaatatcttatgtacatgggaaatatcagagaccaaaatacacattttccctgtccttttgctgaatgaattactattgcctacataacagtccaagagagtaggggttatcatgaaagctcaaggaacttgtgcagttccagtattcaaactcttcaggtgctagtaatctcctgtagattgccttgccatttccttccatcatctctattctacagctatcagtgtttgtcacctcagcctagaaaattccattaacagaaaaggaaaagtatctgaacatttatggggtgataaatatcactgtgatggctgcctcgtggcattgctgttgtctggaccatgcagctagctaggattgatccatatttttaaaaacttaacattaattttaccctctttaatactactctgattgaagggtgaatttaaaaatacagtgaaagggctatgtcgctgtaggaagttgcaattagcattaataatttaaattgtcaattttcatcatcaatcttttatctcatttgttaatattctcaaatggctttcctcctgtcattttaatttaaaaatttttctttaccttttaaacaatttggaatacttttaaaatatattctttttttctgtaactataatttggaaacatggtcacagggtaaggggacacaggacagttttcttacctgcagctgtcccttcagttaatcacccctgaccacatcctcactacttctggaagttctcccattctttctctgtgggatcattaagaattagaatacctaagacattcttgagttcgtaattctcttcaagtagatggtatctttaaacatcttaaattgtgtcacgcaccacccagtatcttttggaagggctatgcattctagtatctatggtttggaatatgttactatttaattctgagcaggaagaaaacttagatgaatcattctatttaggaaagaccaattctacaacgccactggcctatcaaaaggatcccagaaatgtcaaacctctgatactcattcaagaagaagacatggcaaaattctatggtcaaacagggtgctgcttctatattagctttcctctagttcaggagtttgaatatgttctgtgaatggccacatagtagttgttctaggctttgtgagccatgcagtctctgtcacaattactcaactctgctgttttagcacaaaagcagccagaaaaaataaacaaatataaattgatacacttcaatagtcttatgtacagacactgacatatgcatttttaataatttttatgtgtcctgaagtatctagttcttcttttgattttttccaaccatttacataaaaacaattttcagcccatgggctgtacaaaagaaggtggctgaatggattaggcctaccaattatagtttgcccatctctgctctcatttatctgactagttaatttgccttcctcttggtgagagagtctcttaggcattcttctctattaggaagctcaagaagttggctagaattgatatggcccctattaggtcagctcttttcatggttcccatggtaacattaatcctcatattgaggatcctggacccacatgactttgaaatccttaggagtgaatgactattacaaatgtaatcatggtcaccctatgaaagcaatcaacatccgttattttctgactttttaacaaaagccattcagactggtgtgagatggtatcttatttagggtttaattggcatctctctgatgattagtgatattgaagattttttaatatgctcattggccgcttgtatgtcttctttcgaggagtgtctattcacgttctttgtcctgtttttaatctgtttttttttaatttcttgttgacaagtttaagttccttatagattctggatattattcttttgtcagatgcaaagtttgcaaatattttctcccattcaggaggttatctgtttactgtgttgattgtttctttttctgtacagaagctttaatttaattaactctcatttgtcaatttttgtttttgttgcatttgtcattgaggtcttggtcataaattctttgcctaagccagtgtccagaagaacttttcctaggttttattctaggatttttagtagtttcagggcttacatttaagactttaatccatcttgagttaatttttgtatatggtgaaaggtaggggtccaggttcattcctctatatatggctagccagctatcctagcaatatttaatgaataaggtgtcccttctctgttgcttatttttgccaactttgtcaaaaatcagttggttgtaggtgtgcagctttatttctgagttctctattctgttccattgatctaggtgtctatatctgtaatagtattatgctgtttgcgttactacagctttgtagtatattttaagtggggcaatgtaatgccctcaactttgttcttttggcttaggattgctttagctgttcaggccctttcttggttccatatgaattttagaattgttacacaatacacccatgtaacaaacttgcacatgtaacccctgaatctaaagtaattttaaaaagaaagtaatcgagaaacagagaaagggatatggagctttttgcacagttttcttgtttacaaaaagggaaataagatcattttcagaggaccttcagttctgatgttacctcacccagtgacttacagatctgtcctctctaataacgattctctctgaatagaagtgttcttaaggatagaacagcactgctgccacacaaactgaccatacacaggctaacttttggttccactttgatgaaaattctcagttctcggtttgcgctattcattcccttgactctgctttcacaaggaaatcattgataagaatctgtcgatcatgcttcaatgtagataataaagaaaaaaaaagccacagaaacatcctctttaaaaactggaaagacaatgttccttattcatctcgctggaattaatctgctaggttcctgtcctgttgctcaatcagcaggagaatctttggccaatgcttaggcaaaccgaatgaacagtggccatgctcttttgaaaccaataatactcacgaagtgggtgttccttaattactaagcgttatcttacagaacctggctagtggagtttccaaaaggaaaaatcccaagcatttgcttttgtatgttttcttatgttcttatatgtgattttagacacacagaaagtataccaaatgtaatcattacttctgtatgcataactcatcttaaggaatgaaatattacaagtatcatttaagtgtcctgttcatatcccacccaattcttttgtctttcctcacagagatagctcttgttctgtattcagtttatattaattcccaaacatctttctgcttttactatatattatatataactaaataatgtatatttctacatattttatcctttgtgtaaatggtaacacactgcaacatttaaggtgtttccaattttactatatttctcaagaagcttgatttttataacatctctttcatcgttttaggcaaccttccccttcctttttaaagggcacagcattagaaaacaaatggtgaattgccccctaagcctatgccaagtttataaagaacataactgatcttttggccagtgtaagaaactcttctggccgggtgtggtgactcacacctgtaatcccagcactttgggaggccgaggcaggtggatgacctgaggtcaggagttcgagaccagcctgaccatcatggtgaaactccaactctaccgaaaacacaaaaaattagcagggtatggtggcaggtgtctgtaatcccagctacccgggaggctggggcaggagaactgcttgaacccaggaggttgcagtgagccgagatcgggccattgcactccaggatcggtgacaagagcaagactccatctcaaaataaataaataagaataaactctttctttcggtatctatttggtttccctacaagttggaataattcatctcaatgctagtagtacctctctgaaggtgcatggggctgacttaagtattgctcacacaatgatggttgtctcattttattaattctgtgtattttatggtaggcctaaatgatagttgtgatgggaccttattgagaattttggtggtactggaaaactgcttgcacatggactatggccctataaataggcgatgaaatactattaaattaattaaataacataatctagtaagaaatgaaggaacagcaagaatgcctggctgctttggtggtcaccaacatagtttatattatagacaatgcatcatctggggcctgcccacagccacggtaaggaggtgaaatgagtatagagaatccaattttttttttttctcataaaaacttaagtgttagatcattgtggaagggcttgatttgatatgacagggatttttgataaaccgcattggtgacatgaatacagtaagccagaccagattgcttttgattttaatgttagattcatttttctcagcttcgtaatgtaagaaaaactgaattgaactttaaatatgcttatacttttctaatttaggataggaaatttcctcgattatataacacggctagttaaaaaccaaaaccctaaaacttttgtgtcacatgaagactttatgaaatatatattactatagattagtaaaatctgtattgtttttaaggtgacttctgattctccaattggagcaatacttccaaattctttgctaattttgatcttgaaaagtgaattctagttttctcatatcacaggaaaaactagtacatttagactcagtattatcattaaccagtatattaattttcatcacactcagtacttgatacttcatgccccctataaaacattctcacttcaccttttaaatgccatcatcaagtaagagagtactactgagctttattttcaatagcttttacagctaaagtaatagcccaactgtgttttcaaataaatacattcactgagagattgatacaggttcctagagaagtcaacatattttgagttgtcgatggtgagttttctttcttcaattatgcttggcacgaaaaggctcaatagccaatttctctgtgactggttcaaacccaaaactctatgttagcaaaaatttttagctattgaagccttctagtactatgacatacacatgaatatgaagccctgctttccaattagatatagggccaagtatagaaatgtgttctcagttagaaacaatctggcttctttccaggaaaaagatacagaaaatttttttctgtattcagagaaaataaataaccttcaaatctctgatgtctaattctacttaaaagctcagttgcaggaaagcatattcacagaaggttacatgatgtgacaattacgtattgcatgcctgtataaaaatgtctcctataattcataaatatatacacccagtatgtatccatacaaaattaaaaattaataaaatagagaatctgaaaatctgaaaacaattgctagactactttagacttctgctccaatattttttcctctcatagaattgcttttcctgaatggccctttagcactaaatttttctttttcatggagccatgttggtagaaaaaaataaacattcttattgtttattataagaatatgaatcagcgtgttatcacctttatgaccctcccatttattttcttctggcactaagttctagcaaaaagctaacatactactagtaaagttaaaattattttaattattattttaataatttggaaactttgggtctcaaaaatatgtttacttcttggttttgtcttttaggaagcttggcgccaatttgtggctttaaaatgttccctgtccattccaccacccatgatacattgtggatatatttctatgcaagaattttttattatttatctactataattttccttttcctagttttccaatttatttaggcttctcaagttgtgccatatgtatctcttcaagccacactaaataatttttctggaatttaatatatattaaatataattaagatactttaagataaaactgatactatttaactatagtcaatgtacttgaaattatgctttgtttggataaactaaaggtcaaaaaatcacttcatgagtaattgacatttttatgtatttgaatatttgaaactagatgttcaaatactttcatacgaaaataaatataatgttcttgggtcaacagaactgggagaaattcagcagatataaattaaattgtctaaaaattttttaaaataataaaaaagaaattgactctagatattcaaatttgctgcagtcacattccaaatacttggaatgatcggcaactacatttaatgtattgcatttaaatgaatttaatttagtttttaaaaatgtgacatttatcttttgaaacagcagatgaaacttatagcttgaattaagctctccacctaccaagaaaccatgagaaatgagaatgtactcaatagtcacggggtttcatatatgagagtttgaattttatgttaaaatattagaatgattatcataaatgtgactggcttagatctgcagggcatatattcttttatgattgttatttttaaagaaataatgagaaccttccaaataaattggtaaaaaaaaaaaaaagttctgtaattcagatgcaaatgaatatactttatttgacaactaagagattttagagtatgtcattaacagcttagtgtttgaaaagatctagatagagtgataaattatctttattctataaagaaagaaaataaatgccagttttctaagctttttttttttcctactagatctcacagtagctttgctccttgacgttatgaaaaatactttccaggcagattcaacaagcagacaattctccagactattcaagccttctatatgagaaggataacctagaaacctctgcaaaggtcattaccttataacatttgaatgatttcatggtgaggctaatgcaaaaatacctcaagtaatatgtttgaatgataagaaaaaataaggctaatgtgagttttaacctgtatatactgtatcttccttgctatagtaatctcatgtatgatcctgaataactataattcaatatcttatctaacattacatttattctgaaagagaagaaaaacaatttaattccctactatttatttggaaatattttatgtaacaaaatatattactacttgttctctgaatctacataaagacagttttcagtttgggtctcatttatacgattgtaagtttttacataaggtattgaaaatttcccaactttgaataatctggatagccacattgaattaaaaataaagtataaacgtcttatacatctagttaatttggtaactttaaaacattaagtgggtgtaaatggcctaacacagtggcaaattttgaggtaaaacatgttatcaatatcagctattttctttatatcaacacactttcaggtaatctggtaatgaataaacagtaaaaaaaaaaatactaagctatgagtctcttgactaagttctaagcagcatgaaatgattggccatcagagaaagggcaagaatttaacggctaatgattacaggagtcgctgtgtcatttggtgatggaaatgatagcccctgcatagacaccttgagattctttctgaaatgcgactttggcaatatgctaatcttgcaagtcctgtccagcccaactgtcttcaatctctgtgtccttgccctcttcatggctgtgggattcatctgggcagtatggtcttaggcaagccagtacattataggatctcatctctggaccaattttcagactaatgacctatgtatttcttaaggtcttattcataatttactgaactctaaggaagcttttggagagactcctgctaaagcttaccattggttttatcatggtcctgaaaagcacagattaatttttaagaaagggaatatgaaacaatattaatatttataatgctattattgctacatgttaatacttccttacaaaatcatattatgtgttttcacgtatgttcaaaataaccttcagtgatataggttttacctttccccaggcaacttcagaatccaaattactaggcattccttcaactgctgatctctttgtcaattccatatctgtagctgccagccattctgtcaagacattcatttcctttcgcatcttacgggacaatttcaagcatttctccaactgttgctttctttctgttacctgaaaagaattataatgaaatgtaatttagtttactctttaattcaaatttcgttataaccacttatttggaacttttatatttctgttatttaaaataactattttcttacacgttttaaaataatattttataaaaatcatatattctgaatattaagagtgaataaaaactgtctagggcagatgacatcgtttgtccaaaagatagggtcttgtatgtcgtcatggtagaaaagaaacctatacgaatttttctctaagataatttatagccaaagtttatgataaatacaatgatataagtcaaactgaagataaaactcatttctcactgaaaacttactgtcatgtgtcaataatatggcaagaaggtttacaatcctctatatacaagtgagactagctcatgctggtaaggaatcaaaatgaagatagaagattaattctctcaaaaggtaaaagtatttgtgtaatacctagaattctcaactgtatcctcgttacatctttaaagtgtctcacatctgctcaaaaacaatacagtgaataggtcacttcctccttaaacataattttgccatccaatagggacaaaaagatgaatgtgaagacaatattcattcccattaatagaaaaactaattacttgatcctgtgctcctgttctcagtgtttgataccaacaccctcaaaagcaaattatccatattctcacataagaaatgaacaaatctgtatttctccaccaccttctcagatgtgcctatattttgttaagattttcagttggttggtttaataaaaatcccagcatctctttctactaaaggcagtcaaatcatcaacaaaagccagataaattacaatttcttaaaggcaaatcttcttgcctcacacatctttagattactcctctctactcctgaaagttccttgaacaaagaaaggtctcactaaatatgctttatgtattgaataaaggaatgaatgaagacttgcaaatcgttaattacaagttagaaaatataactggtagaatttacataaagagtttatactcttacaagttgctcctggttttcttttctttggtatgtgttttcacctttttttaaaaaaaacccttgtctgtcatgaagcctgggaatctgaacaatagatataaatatttggctctgcagaaacagcatgatggaatgtaagtatgttaggctctgcgatacgtagtggactctcgacttgagtatgatttttggcagaacacctcatttttctcaacacatctgtcaaatgggattactatacttattaatagaacacaggaatattgcgagggtaaaggcagacaacagtttgagagagcatgacatattgtaccacctcaatcccttcctttattctcattatttacctttagggatggttcaataaaaaactgtgcctgaatgtatagagcaaaagctttatttacatttattttactaccttacaggtaaataaaacatggacaagatttggcttttgttgctaagaaatctgaaaggtagactccagattaatttcaattgtaatggaattggttaaaacaataccaccaccacaagtgcgttatttgtgcattatgccctaagcccaataggcaccactgactgatacatatatttatgtcatatatatgtgtgtgtgtgtctatgtgtatgtgtgtgtacaaccaaaataagaatctatctataagcaagaaaaacacaaaagataaaaatatgtataaagcatctaaaatgctacaatcgaaataaatattctggaaccttgataacaattccaattccaaataataaaattccttattttctttaggagaggtgtgcgtacatttagaaaacatttagttgctgaggctgtaaattcattttttaaacagattttcccttctatttttttttttcctaagtaaaagcatctgcccttttgactgcaagaattttgtgttgtaggggtgtgtggggggtgagggaaaatatactttatggtgtgtttctatgcatatttttcctatgcattattggtagaaaaatgattccagattcaatatttcaaagaaattctatcttcccagagctaatgcagtattgatttttatttatttcattttgtttatttccagctaaatacatttttaaaaaacaggagacactgccatcttaaggaaaattgagttttatactttgtgtgtgtatgcgaggaatggatacgtttaacacaatgccacctgcagtaaaatgttttagtagtcattgtttcacgaagttaacaatgtatttaagggatgatattagtattgctatttatgtaaatttccataaaaatcagagcatagagaaataaaaaggggttataggtattattacatcaatggtgccagctttaatatctcttaataaattaattatattttctctccccactcatcaccatgtaagaatacagcaaaaaggtaagacaagaagaaagctctcctcaggaatgaaatggatcagcaccttgatcttgcactcccagactccacacttgcagaaatcaatttacctagtttattttattgtgttatggcagccagagctgattactccaaaaaggtaatgcatactcaattgtggcagacacaaccatataaattctgaagatggttaaaatagaagggttccttcttacataaaaagaataatgtaataacatttcctttgttgcctttgctttcattagacaaagctactgctgttgaaaatattttgagtcaaaatccagacaatatttttattctcaggcaaagaatataggacttacagcatttttataagatggtatttatacatgatcccttagtcacaaatgtttctacatcaatatttacttcaaaaataaatgtttggcctatgtttttgctgtattctgtgatactattaaagttaaatatgatttcttcatacacttttattttgctttaaggatattactatgtggcaaatggttagaataaacacaagctctcagatatgtattttcaggaataaatagggtttgacatcattacgagaatcattcatttctgaataataatcaactcagggcactattattcgtctaatgtcactttcattgctttaaattctaattgatttattctgttattttatgttaaatttactcttgcaatgatttcgtaaaaattcctatgacaaataaaaagcccacacacaaaaaacctctattttaaaaagtaaactgagaaactcccctttaccaaaacatatattttcttaatttaaaaaatactcatccatacattattttagtataaagtcacacaggtcaaattataaactgaaaatttgtaatttataactataacatacattcattttattaatttaaaatttataattacaaaaacaatatatctccagaactgaagctgtagcattaggattaatattagagattattcaatctctaatacatttgagactagagattactcagtccttcgtaattgatgttaaatatgaaataattggcatctataaaaattgataagcaccggaataaggtatcaagtgcagatacaatttttctgtctgtggtgatctttaaacaatgataaatttctctagaggatataaaggtatctcattccaaaggtaccttggtagaccaaatgaacagttgaaatgtattttatttcaagattatcataatgctttcccatcaattgagtatcagtgtttcttattttgaaacaaagtaggagaatcttttgtcataggatggcaacaaacttgtttaaaacataacaaatattaattagagggtttttaaaatataaaaacaagactatctaagaaaaatgattacttccagatttcaacttaattataaaatttactttctatggtaaggaattggcaactaatatcttgaagatataaccttcaatctactttcaggctgagatgcaagaaatatgcctctccttagctatttctcaaacatggacattcatatttctgtctaagatgaggtgacaattttatcagtgatgttgttctattcactaaagttgagaacctgagttgtaaaaatataactttttatcctccaagaaattcagttctttcagtcagaacgaaattaaaatgttagaagtccatttttggaaatactaagatatccgtttatggaaagatatcccatattcatggattggaataaataatattgttaagatgtctgtaccactcaaagcaatttacagacttaatgcaatccctattaaaattccagtgacatttttggcagatgtagaagaaagaatcccaaatttcattttgaacaacaaaagacccagaatagccaaagcaatcttaagccaaaagaacgaagctggaggtatcataattacctgattcaaaaatattctataatgctctagtaattaaaagagcaggatggtagtataaaaacagacatatagaccaaaggaacagaatagagagcccaataataaatccacatatttatgatcaactgatcaaccaaggggccgagaatacacaatgaaaaaaggacattctcttcaataaatggttctgagaaattggatatccaaatgcatgaaaatgcaattggacacttatctcacagcatataaaaaaccagttcaaaatggactcaagacttaaaacctgaacctataaaatgatttgaagaaaacaggaaaaagcttcctgacattgttctgggcaaacattttttttggatctgactcccaaagcacaggcaacaagaggaaaactagacgactgttatcgcatcaacctaaaaagcttctgctcagcaaaacaaacaatcaacagagtgaagagactacttactatcataatctatacagaatatttgagttgagcgaagtgagatggagagatataggcatcttgaattagcagtgaagtggagctggtcatgagactctgatcaggacaatgatacaaaaataattacagagacgtaggtcttaactggctatccatgctatcttattagccaagtgtggtagattttgcaagtcttggccatatagggaaataattactgtgtaatttttaaacttaatgtggtctctgtggaatatgttaacaacattagacctacatataaatagatacagtttataatatttaccagtcttcaagtcatcacaagtagatatatataatgaaaataaggaacacttacaactaagaaacccttttagagctatctgatggaccaggaaaaacctccctgagcgttacgtatttttcaatctgaataagcagagcctcactgattaattattgtttcttaatgagaattccacatcgaaatatgtgtatatgtttatctttgtgtatatgtgtacatatatatatatacgtatatgtgtgtatatatatacgtatacatatacatagagagagagaggtgtttagaattgctaagactctaatcatacataatttattgcccgttgctttacaatttataaggaaagtggaaagaagtgtttgtggtctcagcatgcacacacctttgctcccagctcattataatgcaatttcaaagctgttactctttcatcaagttctttgggattttccgtctgctttttctgtacaatctgacgtccagtctttatcaccatttccacttcagacttcacttcactcagacttttatacaagttctaagtttaaacataaaacaaaacatgataatcagtagagttaaattatttcataatattatgaacagaaataaatagagatccccttaattgctattccatgtttgaaattttaatagagtagcattttgcagcggtggtcaatatctagcttttgcattttctgttgatttaatatttctaattgtctacacacatgcatatatgtgtcatttgcagctattcttattaaacagagagttaatcatatatatgtgttttgtgatatatatatatttagttcttcaatcaaagaacataaatgtcaattctgaattttacatgacttctattttaaatgttggagttatataattctagccataaatttggatgaattaattcactcctacatcgggtatttattgagtggttactatcaatcagatagtatttgaatcactgggaagtcagtggtggccaaaacacacacattcactattgttctcatggtacttacatattagtaacattaaagcacctaaatttctacatcataatttcaatatatattgtatcatatataagaaagtaaggtccttttcaatgttaattaaattacacaactttattttcttaaaagtgctgatgaaaaccagatataaaaatattattgacaattcacatgtacatcacaaatataaagcacacacatacggtttcacaaaacataggttgctataaaaaagcatcataagacaagtgtcataactttggaagacagctatgttcacaattataccaccaacaccactccaacaccacttgatgtcttaattttgctttgtagttttcctagaaatatatgtctttgtatgtatgtggccatgtattcaaatatatgtacgtgtgtgtatatacgtatacacgtatatataatagtttacattatgtatctctgctttaatttgtttagtcataaatctgaactatcagtacttattttagtattaccaaaaaataaacctgacagtaggtaattgtttttatggaattagaacaaaaattgggtttaatttctcttttcagtttaaaagtaatgtctaaaaaaaagcattttgtaaaggctggacaattatctgatcaatgctacatgtatatttccatattaatcctctttgacaaatgatgttaacattccttcatcactaataattatgacttttgtctgagtttcccagatgatattatttacttcattttacttttttcttagaagatataaaaatatctgtgtatctggaaacactgaaattaattattatgttggaaatcaacgatgctaatttggaatcagagatttttctaaattatttactctctgaacttcaaaaaatataaatgctttattttgatgaagaaagttccctcaaggtaccgttagccattaacattgtttcattcaataggcaagtaaaatatttataaacaaaggggagaaatattatttatatttgtgttcatgaaagtaagacttttataaatagacaaacatgtcttgaaggcaagactatgattatggtatacaccacaaagcatcgtaaacaatgaaaaaactaaacagtgtaaggatattcttatgaaagaactgcttcaattggtcctgacatttaaaccagaaccagaaaccaattgagcaaatgccttgagcagtttcctttgtactgacgcagggcacagtcacagcttgacacaggtgagattgttttcagctcatatttactgttggatacattttataaggtaacattagagacctgtttctagaaaagaacgaaaagtgctcactttgcaaatattagtcatgaataaggcacttgggtcatttatgctttccttttttttttttttggcaaaatttaagatgggatatgttcccatatattcctatccttactcatctaatatcaactaactactttctatcatttctattccaagtttctttttgggggtgagaataattaaagtaattataccactaaaatgcagcttgaattatgaaaatatattatcgaataagaatacctcatatttttcacacataaatatatgtatttattttaagatatttgttaaaaagaaaaatatttccccattcatgatatgactacgatgtatctgaaggactctgtttttcattgatattatggagtagatgtagaaacaatacttaaaatatcaagtactaaatagacttgttttccctttaataacattctgtgttttcattttatgtgacttcccactctaatggccgatagtacatgtagagttataataatacttatgttactcgagtagatgcaatcatacctcagctttgttttcagaggaatcatctcagttggtgagtttccaataacagcaacataggacaccgttcaatattataaagtttaaatcagatttatactttaggctatttgtacctttccatgccttttaattcggtgttgtcttgaggcatttcactgtatatccagtactggtgtttaaaggaaagttattaaagtttggaataagagtacctgaattggaatcttgctttgccattcaccagctgtttgtccttaaattctctcaggtaatctgtagccttaagaattaaaggtgacttctgtatgtcacgtagtttacctggcatccattatttctgaagttgttaggattattgcaactactgttgttgttactatttttagattaatatatttcctttctagatttccatttaaaatatatttaaagaatcataaaaattaaacacaagcaacatccttttatattctgcacagttcttagcagaattatagactcaaaaaagacacacagaataggccacaatacatgtgccaatttttgttctcaatcttaaaattacatagtataattattatggttatctgaaaacaattctctcttataaaagagcagttacttcttaatgaggaaagtcaaggggtacctgcgtatttgccaccagaaatacataccacacaatgatttagctgtgactgtactacttcctgttccacactctttgtttccaatgcaggcaagtgcatcttcacttcatctaaaatcatcttactttcttgtagacgctgctcaaaattggctggtttctggaataatcgaaacttcatggagacatcttgtaattttttctgtaaggacagtgtaaaaaggcactgatttaattttgcctttcaaacaataactggtcctatttttattgatagatctgcctttatttctgaagatatacagaaaaataaaaacaaaataaagcagtatttttccattcatccaacacaggaaaacatacatttgggagaatgattcagtagttttttcttaatgttatactaaataaaaggtaatttattaacctattttatctttaaaatgtagagagcaaaacactcattgtttagacatcaaattatagttttcaaataatgtcctcaaatccaatcttgccaataatcaagttgtccaatatagactggagtataatgcccaacgaaaacacgttccttagtttctgaaataacatatacctgtgcaacatcaatctgagacaggactctttgggcagcctccttcccctgattatgtttcttcatttcttctaaactgatctcatgacttgtcaaatcagattggattttctgttgggaggatagcattattagtcagcatgctctacaaagaacaactaactttccaagaagacgaaattcagaaactctcctcaaccacctctaccatgtagcttcctttaaaatgaccgtaaattggccaagagtggtggttcacacctgtaatcctagcactttgggaggtcgaggcaggtggatcacctaaatagaattatcataaatattttttactttcataaattatccaagtgaaacgatttatttcttccctatgggattattatgaaaaaagcaataatcattttgagtcaatatcaactatttcagatatcattttcaataggtaatttatatattatatgtagaattgatatgttttatctttgaagtcacactcaaatcggaccaaagacatgatgttaatctgtaagattcagccaactgtgacagggatgagatataatgagaaaattgcatgtggaaaatactccttaattaccttctttttattttattttattttattttgtagaggcagagtcttgctatgtgacccagcctggtcccaaactcctggtcttaagcaattctcctgtctcagcctcccacagagctgtgattataggcgtgagccactgtgcctggccttagtgtagtctactcagtcattatgtgccatatttcagttaaatttcagggaagctatgaatctaagaaatggaagtcaaatgccccaaacaggtattgctatttgtctgatagatatttgatggcttccggcagatactgattgtgaattttagataactataaaacatttcaatatttatatattcaataaagacattttcgatcaagttctatagtaaagtatattctgcatttaacatatgaatttctgagccagttataggcagggatctctgcagcatgtggacacgaacacaatacatttatttatttatttctgtcaaatccatacaaaatcagctagcggtcaaatcattctaatttaaaattcagtcattattagattattataatttagagcagaaactaaattataccagagtgcccataacattatcatgcagatcattttgcataacgtatattagtgtaagtgaatttacaccaattggagtaaattctgatacatatcattagaagataacatcagttttgcttagcagtttccagagcgaactatagccctgaactgagtaatgagaattataccaagaacatggactaagtggttaaggagctccttatgcaaggttataaattcacagatgtacctcaatattattccttagaatattaatcctaacaattatagaggcaaatcaattatgaattacctaaatagttagaattctgccttaaaacaaatgagagcaaatacgcatataaatgtatcttattttattaccatatcgatgatcttcattggttgaataactaccttgtgtgagaaatattgatatgtttcgtgaacctagaatctgggagtagggatccatctaggtgcatgacgttatttatagagcaagaaacatcacagaatctataaaattggatggaagtatgcagggtggagtgatgcttgtacggaggatgtcataagggagttgatgttaaagtagaactttcaataattagtaagcattgctgggagtaacagatgctttagaggggttatggctagggcctttcatcttggaaatgttaatcctcctcaaaaaggtgggccagtaacaaccatgtctgtgccacgtaattctggccaactccatgttatgggtgatcagaatacacacaatgcttgtgttaagagagaatcatcagaatctctctcagaaaattagaattgacagaagagtctggtcaaactgtgagtgcttcgaattgtgtcacatatactagcaaattgtgcttacgaagtccctagtttgcagagtggattgaggaagagcaaaggtccatgaacagagagagaagaaagaagtagatgcatagggagtgaggtggtaacaaaaacactgatggcttccaatgcggtatggctttatttatttatttagttagttatttatgttttgagatggaatctcgctctgtcacccaggctggaacgcaatagcacgatcttggctcactgcaacctccgcctcccaggttcaagcgattctcctgcctcagccaaccaagtagctgcgattacaggtgcccaccaccatgctcagctaatttttatattttttagtagcgacagggttttaccatgttggtcaggatggtctcgaatgcctgacctcaggtgatccacctgcctcggcttcccaaagtgctgggattacaggtgtgagccaccgtgcccagcccgtagatagcattttcgaaagagggctgcaataatagctcccacagcacatgctcctcttaccactccctcaacaagaggtgaagtttatttcttcagctctttaaatctgggttgactctttgactgctttgaccaatagaatatagtccaagtgccagttatggcaaaagtccttaagtggcctggcagcttccacgtctatctttttagaacagtcattcttagggtgctcccttttagaatccatccaacatattatgctctgagaaagctaagtaacatcgaaaggccatggataagtgcttcagcaacaatcacaacaaggctttcagccaacaactgctaggcatgtgaatgagtgatcttggacgttcagcccagttgagcattcaggttactatagtatcagacaacaatggactaaaatcacataagaaaccacaaaagagaaccatccaggtgagctttctcaacacgcaaaaccattagtgggaataataaatggctatcataaataaccaaaacacaggcattagtcccttcttgagtcaaaactttattactgcccttggattctatgacacattcctgtttccatatgaaaaacctttctctctcatttgttttgctttagttacttcaattttgttacttctaaatgagagtcctaaatactgtatatgcatactggatacgcaaggatataggagttgtaaaaacaaaagcatttctggttgaagagagacaaggtgtggagacagggcactgaagagcataaggagtttggcaaaatttaacaagaaatgtaggtagaaatcaggtattaaataactttatgtcccaaatgaatggttaccactattttgatcacgaagataaatttcaaaatttgaaattgatcataatcacagataacagtagttttattgctaatatttgatccgataactaaggaaattcatagggaggaaatgcgactgtaaatcagcagtatgttgaagtgagtttgcattttaataatcactatgtgtgtctgtacagagagaaagagggaaacagggtacatttgtataatatgtattttttcagtgttttcaagcgttagaggaaagcagaaagagagaacaaagagagaaccatggagaacacaaatttaactgacatggaaagaaaagcaccaaataaagagaaagaacagtcaaagagaaagaaaagaagaactagaaaagagagaaaatctcacatcaattgatgtgagaattttaagaatgagagagagaggtcaacagtgacagtttgagataggttcaatgggatcaatagtaatcagggtacatgagctcgtcaatgaccattgcagctagaagagagaagtggatgacgagagcagaaatcgtattttcaagggctggcctgattaaggatcaaggagcactctaataaaaatagtttaaattacttttgcagacttttgtctccacacataataaaattcaggtcaatcagacttgaacatactttaaggctacatgaaagaagccaacacataaagtgattttttttaaatgtaagaagataaacttgattttaaaaaaacctgtttaaagcaagaaaaccagagtgaagcacaaagctcagggccaacggaaaatatcaacaggaggagaggtggctctttttcagaaaacaaaagtaagatgtgaagacgcaagaagttgaatgcttcctacatggtgctctcagagtatcagggtgaaatcatgttaacagtaaccaggatttaaatttcagggctctctcttgccaccttgggcaaagcatcaacatgttctgaaccttgattttctcatgtctagcccaagaatgataatagcaagccagcaatgaagttttcttatctgagaaattctcatttcttcagtagtcaactacattggttttggtcaaaaagatcagatgtgacagtatatgtaaaaatacctgtccatgttatttgcacaaatatttagttataagttatcagcgatataacatgtcatttcctcgtaagcacaaaaccctaggtatctgctgaggatgagaggagagaatcaaggtggaatttaaatcaaagtgataaaagttcaatagcaattgtggagactgtgaaaggaaactgatttaaaaaaataagaatacactcagagagggtagagggcccaaattatacatctgtaatcatatctgtgtacatgtatttaaaagtttttccatccccttagcctccaaggttagtagaggaaaaaatgaagtatacacatagtcctttaaccttttataccagagtggtcaaagaagagcaaaaaacaaaaaaacaaaaaaaaaaaaaaaaagaaaagaaatcatcatcagtatcctcaccaccacagatatttgtgggaacttatgtgctaacactttatataattaattccatctcctaatcatattaacataagtatttatcatcttcatgtacaaatgaaggtagaaacatcaacatgcccaaggtaacataactaggaagtaacaaacttgctgccctctaacaattatactgcctctttaattatgattttaaaataaaagtatcctccaaatggacatttgtgagaaaaaaagaaatttaatcttattcgtatgttgatagcatttagtcaatttaattcaacaaatcgttcagcttctactactcaattccacacagtgagaacaaaattgttgcccctatacttacagaagccttattttaagaggcagactgtagatatataagtaaattacaaagcagaaatatatgcaatgtaatagaaaaactaacatcacacaccagggcctgtcgtggggtggggggaggggggagggatagcattaggagatatacctaatgtaactgacaagttaatgggtgcagcacaccaacatgtcacatggatacatacgtaacaaacctgcatgttgtgcacacgtaccctagaacttaaagtataatttaaaaaaattttaaaaacagaaaaacccatgctctgtgatcagaaagataaatattaatatctgctgtataatctggtgatttttaggaaatttacatgatttaactagcatatggctgagaaagggttttggagggtcagagaataagaatataggatcttattttaggctgtaggaaacaagctagcaaagattaggcttggggcatgcagagtgtgtgtgcttaatttaatgggaggaaagactgaatgtgagttagtaagaattactatctagatgaggaattagtatgaagctacagaaccttaagtttcagtgcctctcacttgcaagagacccttctataaaccagcatttaattttctatttataattttttttttcaaagactgcccctggaaattctagaagctcagcattacaaagcaaagcaaagatagcgtaagtgatcactgcaacacaggccttcctgataagttccacattttcccaaatgagtcatattgttgtcataagtcataaataataggaacaacaacagcttacatataaccaaacactcgacttttatctgttggcaggggacatgaaggaccaagtaacctgtgagaggaatgttgggcaatttggagctcaaggcaaagcattccatggaatttgaaatatacatatttccattaaatagttagaaaaactgttgaggatgagcttctgtgtttttagaaaggtcgccaccactaaaattattaacattgaaaaaaatcatcattgaacatcatataaaagtgagacttttatcataatgtataggcatttctagtgaaattcgcatatttgtagtactgttccaatatgattagagataaaattttctttatgcattgagtagattatgcattaaaaagaactcagtggttaaacatattttggaaattgaagatgaacatgtgtctataccacagaacttctcagaatatttattaatatatattgtgtatatccaagaatcatacaacactttgtagatgttatccttttgcttttttttgccagagtgcatcatacaagtagatttggaaaaaggctatcaaatatacttaacatattcattaataataattcaattcattactaaaattataaaataaaatgtctttatatttccaattgattctactatgggtaagctgtaaaacatgcatgacacatatttgccagcatctttacacattaattccacaaaatttacatttaaattgtaattaacttttagcttgtacttaggatatcttttaccagctactttacctaacctcgtcagaactgtattctggaaccacataagtaaaaaatgcttagcactttagcgcaggcttattgtgaaatagaaaagtaacttgtacaaataacagaatattattgaaacttctgggaagaacaatctcctatgtaaaaatcactcataaaaaaagacaatgtaatcattttcttttttgacattatgagaatatgatgaaagaaaataaaattgtggaagaaaacattggggatagaagattcaatctgaaggaaaatgatctctctacttgtctactagatttctaagttgtcctaaagatgtgagggatgtataatttgagttatattttcacctaatatatacatctagggggatatggatagtaagcatttgaagaaaacaaataagccaaccacatacaactattcttgtgaaattatcagcctggcttcgtataaaatcagtaaactctaatggaaacaaagtgagaggacatagcaaatcacggatactgatgtgaacactcacatatgctctatgaggtgttctcaatccagtacctttcagaatcactagattttcttcatcaaagtcaagtaatataaagcaaattatatcatctttccattatattaaaaaagacatttgagcttatctcaacattccattataaaaaaggcatttgagcatgcagtaactatgttcacagcactatatattcaaagtaggaaaataaaacaagtgaaatcgaattaaccatttttccattgaatatggtaaagggcaaaattatagaaccaaaaaatcattcaaacattaatcacattttaaatataggactttacagttaactgagcagagagcagggctgtttttaaaatcttgctttacctcatcaaaccattctcatatatatagtaacagaaaatggccagcaaaattatactgcagcaggctaaagtacttaacagaatgaagaaaatgatatcaaataattattggagtttctgtggtgtcaaagaaaggaaaaatttagagaaaataagaaaatattttagtaaaagatattaaaatacttcatgttgagactactgattgatggaggaacgtaccactgttagattagtaattttgaaagagccagtaattttgaaattgctattttcaagaaagggaaatggccacatatcacacgtacttagaaaacgaaagaaacaaaatatatcaaaagatttgggatgatatgtactttccaaagataggaaaatgcaagaaatataattattttcatagaaaaaaaatgttgaaaagtttcaggttatactttataataattcaacaagtaaaaaaagaagaaattcacacagctttgtactactctttttttaaacccccccccccaagtagagttacttagaaaaatattacctttaaattaaattttgtcagctaaagaagttttgacttttatcagaaatatgcaataggccaaaggaaacagtctatttcagtgtctcccctacattgttccttgacatatgagttttgtggtatatcaacatatttctggaggaaaaagtgtctgtggcttcttatcaaatttaggttaaacttttatttttgaaaatacaaaaaagtgggtcaaaaatctccagcagagaagtaaagcatataaatttttctgcgtaatcttgaccacagaaccgtttaaaaataaaaaattggacattgtgtataattattacttgtaatatacctgagaaacgatgttacgcttagtcataataacgacaacgataatagaagagttcattataataatgtattttctaacaaagacattcttcacagaaatagaaaaaacaatcttaaaatttatatggaactgcagcagacccagaatagccaaatatatcctaagcaaaaaagaatgaaactggaggaatcactttacctaactttaaattatactacacagctatagtaaccgaaacagcatggtactggcttaagcgcaaacacacagcccaatagaacagaatagagaacacagagataaatccatacatctacagggacctaatttttgacaaagtgccaagaacacactttggggaaaggagtccttcaataaatggtgctgggaaaattggatatccaaatgcagaataaaaccagacctctatcttgaaccgtatacagaaatcaaatcaaaatggattaaatacttaaatctaagacctcaaattatgaaactaccacaagaaaactttgggagaaacctccagaacattggtctaggcaagaaattcttgaaccataccacacaagcacaggcaaccaaagcaaaaatggacaaatggtaacacaccaagttaaaaatcttcttcacaacaaagcatacaacccacaaagtgaagagacaacccatggaatgggagaaaatatttccaaactacccatctgacaagggatcaataactagaatatataaagagctcaaacaactctataggaaaaaactaataatctgattaaaaatgggcaaaatatctgaatagacttttttttgaaagaagataaatgacaaacgggtatatgaaaagggtctcaatatcactgatcataacagaatagtaaatcaaaaccacagtgagatataatctcacttcaactcaaatggttttatttataaaacaagcaataacaaatgttggcgaggatatggagaaaagggaaccctcatacactgctggtaggaatgtaaactagtacaaccactatggaaaacaagttttgagattcctcaaaaaactgtaaacagagctaccatacaatccagcaatcccactgctgtgtatatacccaaaagaaagaaaatcagtacactgaagaaatatctgtactcccgtgttttattgcggcactgttcacaaaagtcaagatttggaagcaacctaaatgtccattaaaaaacgaatggataaagaaaatatggttttctagatatacaatcatgtcatctgcaaacagggacaatttgacttcctcttttcctgattgaacaccctttatttccttctcctgcctaattgccctggccagaacttccaacactatgttgaataggagtggtgagagagggcatccctgtcttgtgccagttttcaaagggaatgcttccggtttttgcccattcagtatgatattggctgtgggtttgtcatagatagctcttattattttgaaatacgtcccatcaatacctaatttattgagaatttttagcatgaagcgttgttgaattttgtcaaaggctttttctgcatctattgagataatcatgtggtttttgtctttggctctgtttagatgctggattacatttattgatttgcatatattgaaccagccttgcatcccaaggatgaagcccacttgatcatggtggataagctttttgatgtgctgctggattcgttttgcaagtattttattgaggattttttcatcaatgttcatcaaggataatggtctaaaattctcttttttggttgtgtctctgcccggctttggtatcagaatgatgctggcctcataaaatgagttagggaggattccctctttttctatggattggaatagtttcagaaggaatggtatcagttcctccttgtacctctgcagccaaaaaacacatgaaaaaatgctcatcatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactggttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccaccattctcagcaaactatctcaaggacaaaaaaccaaacactgcatgttctcactcataggtgggaattgaacaatgagagcacatggacacaggaaggggaacatcacacaccggggactgttgtggggtggggggaggggggagggatagcattgggagatatacctaatgctagatgacgagttagtgggtgcagcgcaccagcatggcacatgtatacatatgtgactaacctgcacaatgtgcacatgtaccctaaaacttaaagtataataataaaaaaaagaaaatatggtacctatacacaatacagtactattcagccataaaaagaatgacgtcctgtcatttgcaataacatggatggaattgtacgttattacgttaagtgaaataagccagtcacagaaagacaaacatcccatgttctcagttatttgtgggagctaaaaattaagataattgaactatggagatagagagtagaaggatccttactagaggctgggaagggtagtcaggggttggggaggaagtggggatggttaatgggtacaaaaattagaaataatgagcaagacctagtatttgctagaacaggatgaccataataaaaaagtaatttgagtctacattttaaaataaactaaaagagtacaactgaattttttatatcacaaaggatagatgcttaaggtgatagacaccccatttaccctgatttgattgctacgcattgcatgcctgtatcaaaatatctcatgtaacgtttatacatctactacgtgcctacaaacattgaaaatagaaataacgtattttcaagtaattatggttacttttcaaaatagataaatgagtaaatcaaactctagggaacattttggaatgctgcctagaaataattgggagattgtacttctaggttaattttcacttaataaagggctaattattaaagtggagaaagcagatctgagttaaaatatcagcttcagtaaaaatgctttagcattaaaattcattaaatggaatagaatgtaaacaatgggaacattatgatattactatgtaagatcttgcggacatcagtaggccatcaataaatatctaccatttaagttaattccaggttatttaacaacattcatcacatttcaccctttgctatgcatcaaaataatggagtgaaaaagttgatggtaaccttaaattatctttttaaatatataatagtaattgatatattctctattcaatagggttttaaaaacaactttgaggtacaatttacataccataaaattttcattttaaacatatagtcaatgaacaataggaaatttatagagtcatgtatatatcaccacaatccaactttaggacattttttattaacccctaaacctgtgtgtccattttcattcacatcctgttctcaacccatgcctcaaccattcatctagtgttttcaaatattcccttttaaacacaacttttatacttcattaggctgctgtaattaccaaataacgtgaatgctttcaaaatattagatattcacatggtataatccttaaaaactaggtaatacataaagaggctaaaatatatattttccatcagtctttccttttcatgtgaagagttccattttatactattcaaagtattttggaaaggttttcagagcttcaaagttgggcaatcataaggcattatgacaagaagtctttatgatactattaagttccattggaaaaatggttcttcactattatggtaaacgtaagtggccagcaatttctaaattttatctttctttggtgctatctaatgagtggcaagatggcaaggaccacgttaggcttattcacattttaaattttacactgcctatcacatttgtctgacacatacttagtgactaaacctcagtggaattcaataaatttgccagctatttgttagaaatctgctgggtggcccacggtcttacagctgaactttagtggttagagaatgggaatagacggggaaaatttttaaaaagcaaataaaagatttaacaatcacgataaacgctgaaagaaaaataaaacatagtatgttatgctaagtgttatctggctgtgcattttagatcgataaattttctgtgtgctatctttgaagtaaatattcatttgcataagacaaaattgggaaataataggataaatttggatcacttcaaaatattcagagtgttgcaatagtgttcactgtggctgtagcgtgaagttattagactggtgcaaaagtaattgcagtttttgccattaattttaataatttcatccttatatgtagaatttgtagatagatttttacaaaagcatactatagtttaattgcagtcttaaaatgtacacatcaaaataatatgaaagaaatctatatctttatcatatagccagtgaggacataataatgtacaggttgtccaagtacagtcagtgacgtgtggcaagtttctagtattttacatttcctacaacttgtgtttatgactgtttcccacactattaaacatatgaaactaacaagttattcttaaatggagagtaataagttctgtatagcaacacataggggtggcctttcaatgttagaacagattcaaaattaaatgcactaggtttaccatctactgggctgtgtaaaaagaaaataaaaagtctacatctatggctagataggttttaatatttgaacccaaatctctgggttagttctccatttttttcttctttgactaaattatccaattaccacataaattcccctttgcaggtttctgctgtctaactcataaatcaataaagcagactgtaaagttacactgttccaagtcgtttggcaatcaaatatgcctatttacactataagagtctgttttattccttaatgaaatcaaaagctcaatctgatagaccaaaatctgcagttatatctttatttttaagccattgattttgatagcttggaatgttaacatttaaagatgaccgattatatttaatgtgagttataagatttagcttctttgataaacacgggaagattgcaattacgaattcttcttaaagtgcatttaacgtaattagtttaaattaatagctttctttgctttaaaaatcccctcttttctaaattgtactcacattgttaatgggagggaaaaagagaaggaggaagtctggtctgtagtggactctggaacacctgacgtcctagcttggtgagcaaaccacggcagtatttttcaatatttaattatgaggcactcttctttgaaggtaatttgtttccttcctctattcctgctcataaatctactatgtgggacacgaggttacaaaaaaatgagatcagaattctttgggaaaaaacaaatagaacagtaaagctactggagccactgctaagcaactccgctcttgcttgcagtaatttaagcaacagggccatgttttcccctacaaaatgtgcatcaacacataaggacatggtgactttcaacaggtgcccatgttgggttgttcttacatatcaaagattcaaaactaaaattagtagaaaaggaaaaaaatcatgtatgtgaaagtatctttgtaattttaaaaattgcaagacatttaagtagctatttaaacatagttgtcactgtcccctaaaatgattaagagccatatgcaagttaattgacatgttaacaaatggggttagaaaaaaatgaattgaagaaagccaagcagagttcagcctcaaacatctatattgaacattctttttgtctaaattaaaatttgtgcgatagctctcagctatattttcttccatcacccattttccattagaggaaaaaatcaaaataggagagaatctcaccagtagtttgattgccactctgactccctcccattgaaacgttgacacagtcatagaagagaatctttatagaagagtgatagaaaatgtcgtatgaaaaatactctggaacaatttagtcattactagtagggaaccatccaaagccattctccaattagctacacattagaatgaataaaaaagtttccaaaaattctgaagaccaaatccacctaaagatttgatttgattgctccggggctcagcatggttacttagactgttgctataggattttaggtgccaaaactaaactctgtgcttcaatatatagttctgaaaaattgaacagtaaatgactaaatttgttccatgtgtttctttgcagtcacacaatttcgtgatttaattttttatttatttccaaggaacacgcataggttgttacatttttaatcatagtactttggaaataatcctagtttctgttttctaagatatatttccatatctagaagagttttccccatttgctttattctgtttcaataaatcttttcttaattttgtactttaataaaatctctcattaaatgagctgacactgggtagattgatgctgtggccatataatttaatttaagactgtggtaccagtaccatgctgttttggttactgtagccttgtagtatactttgaagtcaggtagcatgatgactccagctttattcttttggcttaggattgacttggcgatgcaggctcctttatggttccatatgaactttaaagtagttttttccaattctctgaagaaaggcattggtagcttgatggggatggcattgaatctataaattaccttgggcagtatggccattttcacgatattgacacttcctacccatgagcatggaatgttcttccatttgtttgtatcctcttttatttcattgagcagtggtttgtagttctccttgaagaggtccttcacatcccttgtaagttggattcctaggtattttattctctttgaagcaattgcgaatgggagttcactcatgatttggctctctgtttgtctgttattggtgtataagaatgcttgtgatttttgcacattgattttgcatgctgagactttgctgaagttgcttatcagcttaaggagattttgggctgagacaatggggttttctagatatacaatcatgtcatctgcaaacaggaacaatttgacttcctcttttcctgattgaataccctttatttccttctcctgcctaattgccctggccagaacttccaacagtatgttgaataggagcagtgagagagggcacccctgtcttgtgccagttttcaaagggaatgcttccagtttttgcccattcagtatgatattggctgtgggttcatcatagatagctcttattattttgagatttgtcccatcaatacctaatttattgagaatttttagcatgaggggtagttgaatattgtcaaaggccttttctggatctattgagataatcatgtggtatttgtgattggttctgtttatatgctggattacgtttattgatttgcatatattgaaccagccttgcatcccagggatgaagcccacttggtcatggtgcataagctttttgatgtgctgctggattcggtttgccagtattttattgaggatttttgcatcgatgttcatcagggatattggtctaaaattctctttttctgtatattacaaggctacagtaaccaaaacagcatggtactggtaccaaaacagagatatagatcaatggaacagaacaaagccctcataaataatgccacatatctacaactatctgatctttgacaaacctcacaaaaacaagaaatggggaaacgattccctatttaataaatggtgctgggaaaactggctagccatatgtagaaagctgaaactggatcccttccttacaccttatacaaaaattaactcaagatggattaaagacttacatgttagacttaaaaccataaaaaccctagaagaaaacctaggcattaccattcaggacataggcacgggcaaggacttcatgacgaaaacaacaaaagcaatggcaacaaaagccaaaattgacaaatgggatctaattaaactaaagagcttctgcacagcaaaagaaactaccatcagagtgaacaggcaacctacagaatgggagaagattttcgcaacctactcctctgacaaagggctaatatccagaatctacaatgaactcaaacaaatgtacaagaaaaaagcaaacaaccccatcaacaagtgggtgaaggatatgaacagacacttctcaaaagaagacatttatgcagccaaaagacacataaaaaaatgctcatcatcactggccatcagagaaatgcaaatcaaaacaacgagataccatctcacaccagttagaatggcgatcattaaaaagtcaggaaacaacaggtgctggagaggatgtggagaaataggaacacttttacactgttggtgggactgtaaactagttcaaccattgtggaagtcactgtggcgattcctcagggatctagaactagaaataccatttgacccagccatcccgttactgggtatatacccaaaggattataaatcatgctgctataaagacacatgcacacgtatgtttattgcggcactattctcaatagcaaagacttggaaccaacccaaatgtctcacaatgatacaatggatttagaaaatgtggcacatatacaccttggaatactatgcagccataaaaaaggatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggaatgttgtggggtggggggaggggggagggatagcattaggagatatacctaatgttaaatgacgagttaatgggtgtagcacaccaacatggcacatgtatacatatgcaactaacctgcacgttgtgcacatgtaccctaaaacttaaagtattaaaaaaaaagactgtgaattggctaagtgttatcttttgaaataaaatactcctaggtcaacacatgctgttacatcctggcagcatgcagctttattttctaaaagtgtaagctttgcttctgtaggtaagctcatgtcactaaaataagtaacataattttaaatccaattcagaatctgagggcccagagaaataactgatcaattaacacactaaggaagtgagcagctcttttctttcctatagtaataaatgccaatgtgaatgtaaagaagcatcctgatctacatctacttttatatataacaagagtatggttgtcagaaagttgtacatacagtatgcatttccttagtgccatagcttttatatctgaggatctcaaacgatcttaaaatgcagaaaaaataatgctctaaaagattcaaattaactagcaaaactctcagtgcaccacacggtggagtcagacacccacaaatctgcgtgaccagtatatgacagaaaatctgagcaggtatttcaaagaggacttaatatggtaacttcatacattttttcctgcttctccgtgatgaattaagctaaatataccatttatgagaaaagaaattatagtgcactaatattttaattagcaataacctttttatctttaagtgcaaatttatagaaacacatttttgttaatacaatgcattgaagttagtccctattctattcctttcttttctttctttcatctatctatctatctatctatctatctatctatctatctatctatccatccatcaatccatacatccatccatctatccaccccatctctatatttaaaatgtcattttggtggcattcttagtggatccttcatcttacacactgtgcttatgttatttcactatctaacttttgactctctattttatttcatgggaatttcgagctgcttttcaggaaatataatccttgaagcaaatctgagtacctgagaactctgttctagaaaacaattcacttactgccatattaaaataaaaccctggagcagaagaatgttttaagagctttcagatggcttgtattctccaatattatgtattaccattggggagactcaatgtcaagaactatgttgataatgcaggtgtgacctgaaatgcatggaaaatagatttgatctgaatgcccaaaatctctttcttgaagtagatctgaaatttcataatttatctgtgttctgctgtttactagtacttttctactgatgtagttaataacatttttattgtagtatttttttagaaaaaccaagcaaaatattttgctattaaaaacaagtaatgtttataaaatcctgaatccatttctaaataagaaaaaacacacagtgccccttatcacaacctgttcaactaaagatgcttcgccctaaaagctccaattttccttgaaagacaatagtataatagctttgcctatcaaatttgctactcataatttcattccgcaagtctgtcacaaagtaattctttatgcattttgaagtacaaacttgcaatattaatgtctagtattcatactgctcaaatttttccttaattccattcagaacgtcacaagcatttttaatcaaacattccttcaaaactcatgtcattagtttaaatgaaagcagttctactctgtatttcatttatagtcatgtagttcttctcaattcagaaacaattactcattcctatcatgcattttactaaaccctgccgtggtagacacactaaataccctgacttgatcattacactttctatacatgtaagaaaatattacataaatgttgtatccataaatatgtataaatattttatatcaaaaaacctttttcattatgactcaaactgggacggacttaggaatagttaattctagagaacctggcttgtgtaagtttgaaaaatatatatactggagtaggtttgtataaacctatcacacttaccctctaaaatatgtacaatcattatatatcaagacaaattaaaaattgaatcctcaagtatgtttactattatccctcacttctactacaatatttactcttgttgcccagtggaaaactatgatgaggattttatcatcaggattctccccaaaattctctttcttcatccactattgcaattgtatgcactccataaggaaataatattccctggactttttaagcctatcaaaactacctatactctgccacatattatcagggacattcttggtcaaagttagacaatatggtaaattaactcatgctattgtgtatactgttgcccagaacacctattaacggtgattcattaactgtaattgcattgtaaccatgatctacaaatctaatatatcacccccaaattcattttaaagtgaaaaacttcagacatcttcaccaactggcagggagaaggctttgagatttgcagctaaccttctagtgctcctctcatcatagcatggacttggtgattgggttcacaacatgtatataagatttgaaaagcagatctagtaattgcgatcacacaaccctaaagacttttgaataaataatacctatgataacttcacatatgtttaaatgttaattaaaaaatgagaacagcattttaaaaatacttcttacagtgaatgtaaatttagttatggcctaaaatttactcatttaaaagtcaactcagatttattttcaacactattttaattctcattctagaaaaacaggtaaacacgttttatattttcgtttgaatgaagcatgggagtgagtgcatgtagctatattgagcatgatcattaataattgaggtgtaaatttatatcgataattttgtgttactcactgcttgtaactaacacatttttataaaacaatatagaccatgtgactaaacgaggagtttataataaaatgtttgagactgctttccaacaatgccatagaaaatattttctttttttctttttataagatagagtctcgctctgttccaggctggagtacagtggtgcaatctcggctcactgcaacctccgcctcccgtgttcaagtgattctcctgcctcagcctcccgagtagctgggattacaggcgcgtgccaacaaacctggctaatttttgtatttttagtagagacagggtttcaccatgttggccaggctggtcttgaactcctgacattgtgattcgtgggcctcagcatcccaaagggctgggattacaggtgtgagccaccacacccggccaaaaaacattttctttaccatttactatcctatggttttactctagcttttagtatagtttgaagtcagaaacaccagaacgtattgctcctgtctttgaaatgtctttatttcaaattcctccattacatccttaaaaaaataaatcttagactaatgatctagacccccttttcttcctacctacctccaaatagtcaaatcagtgaatcaaaacaaccccatggaaaactagttgaataaatttaaagttagaaacactgcaacattttgttgaagtaataaaaacaaaagaatggaagctgattcccagatgtacttgcctgggcttcctgaggcatttgagctgcgtccaccttgtctgcaatataagctgccaactgcttgtcaatgaatgtgagggactcctggattaagtgtaaggatttttcagtctcctgggcagactggatgctctgttcaagcaacttttgcctccttacagcctaaaaagaaggaataagagtgtatcagttaaatgtttactcttgatagcttttctgtaatcctgctgaacaataaatgaagattctagactcttccacaatcacctttttgtaagacagatttcgcagcttcctggcactcattcagctctgttgatagaaaaaaaatgtgaaggagaaaaataaatagcaaacaaaactataggatcagggatctctgcatgaaaatcaatcacaatatcacgtacattaaggaaataggctggaaaaaaaattagcaaaatcatctcagtcattgcaatctgtctttctcaggtcgaatgttcctcctgatctcattatatagttcaagagatttggtttgcttagaatagggtcatcgtcatcacaatccaattcaagacagataatctgcttccaccagtgagatacatgtacaatctgttcagaatcagctccttgtcaaaaacagaattttagataacagtctggttaaagatttattttgaatactatttcaaccagctttgcatgatcttttttctccctactttctttcacaatttggattacagaaattgtttgtacaattgggtttatgttactgctgaagtagaaaaaataataagtaatcctaatatagctgcaattaatcttgattgtaactataagtatgattaggataattcaataatgttcaagtataaataccatgctgcacagattggaaagtctcccttcaaggatctgttcacttttaacagagtagttgtaaaagtaagaaatagggcaggcaacttattgggaattcattatgtgtcatttaaaatacatttccttaatatacaatgtaaaggcatgattatcaggtacaatataactttctttcccacagagcatgactgaggttttaagatgatcttggtttttatattatatatagaatattagatattacataaatactatactttttaagctttaaaaatattagtgatgtcattattcttcagtgaagccagcctataacacagctttgcccaagtaaaactacagttaaaggcatctagactaaggcaaaagaacaggaagtttagtgatgctgcaggaagagggaaggctttcccagtacttctccctgtaccataaattttgactccattaagattttatcctgggctttcctttcttctcattctacccataccttaacttcaattcctcctcacattctgacaactctcaactctacatctctcaagtccagatctccccttgatctccatacttgcatgttatctcaccctattggacatctcctcatgaatattctgcaaccaccaaaagctaacactcccacacatgaactccttgcatatactcttctcacctacttctcaactccccaacttgcttttcctccttctctgtattttttccggtttcagcgaaaaacaaataatgattccctttattagatgtaattctagatatttctacttcctctatcatgtccttcatcatgttgcatctaatcagtcaatcactaattatttattataccttctaaatagttcttgattccaatcttttctctctctctccattgtctttactctagttaaaatcattactatatcttacctcaaatatgctatcagtttcttcactggcattttactctgccacatcccacctgtaaagcagctgcaatgtgttctctcaataacgaattggggcttcctgtctaaaattctctagtgattctttactgtccttcaaataaaagctctattcttttttttttttttttttttttgagatggaggcggagtctctctctgtcacccagactggagtgcagtggcacaatctctgctcactgcaacctctgcctccctggttcaagtgattctcctgcctcagcctctcaagtagctgggattacaggtacctgccaccatgcctggcgaatttttgtatttttagtagagacagggtttcaccaatttgcccaggctggtctcaaactcctgacctaagatgatccacccacctcggcctccctaagtgctgggattataggcgtgagacattgcgcgcagccaaaagctttatccttaatgtggcttaaaagtcccttcataatataagtcctgctggtgtcttttactccctgctctagctatacagaaattttattttttatttcccaacctacactgtggccctcttgattcttggccttaaacatgttgttcccttttactggcataatctcaattctgacttccttttattggctaatttacatttatcttcttaatgtagtggacatctcttccaagtggctacctctggcaccttctaagttcagggaggtaattcttgcatgttctttgaattttgtatttttttgatttgacaagtaaaaattctatcaagttagagcacgtaacatgatgttttaatatatgaatatgttacgggatggctaaattaagctatttatgcattccctcacatgacattatgttctttcttgcactttgtatgtgccataacatatttaatctcccattaatggtctgcatttactttagactatcaactctaatgagttcaaggattacggctgtcctgttcattgctcaataccagttcctagaatgaagcccaatagctttatttatgactgggtgaaaagtataaggagaaattttaatgagaaaaacagaaaactttaaatagtcaaagacgaaaatggatttacagaagaaattgtaaacaaaggtcaccactgctcagagatgtatcttttggacaataaatctatctgtttttgtattaaaagtgtcagaatgggggtgggacattatttggagaaaattttaatctctttctattaaaattctgtatccaagattggtgaccgaggctttgccctatattccaattcaaacatagcttccttttgttctcagtcaaaatttcaactaaaatttacatcaggtaatttactatttcagataacagtgttcagggctataatcagagcctctattgcagaggagactggctgcagcctacccacagctcttccaaagaaatggatctctagtgataaaatttcagcattgtgacaggtggttggagaaaacttccaatcacagcgtgtaataattgcctagccaggtattaaatttggtccttcctctggctaaaggcaaaaacagtgtactctacaaggcacatctgtagattttaattgtataggatgtaatatagaataacattaaaccacatatctagcctcaaaattctttttagaaacctaactttttctattcatgagattctatgagctgaaaggaacagtgtggcttaagaaatgatggcagagttgacttcgggtgggttggctcttttcctggcctgacagtcaataagagaggctgatttacacagattccttgattatctcagtcattgaaaagacctcatgtcaatgcaagcttgcagaattctttcaactagtcatggcataagctgccttctatttctaaacatctgattaggcgcaccctgatggaatgtcaggcttatgaattttctgactttctgcccgcttgacctgtgctgtctcattgaatgaagtttgtagaaagtcttcaaccataatctgattttttgttgttgttccagaatactgttccgctgttgttttaaaatgttatttcatgtctttagctaatccacttagcagtaagaggaattatatagctagacagaaacagcaaatataaggaaagttagaaagacatcttttaataactggcgatcaatgacaaaaatataaaaatagaaaacaatcctagtaatggttaccaagaaaaacacataatatattttaacccagttttcaatgaaaattaaaactaagtaaaagttaacacaaattaattattttatatctttaaagtactatggaaatataaaataagtttaagaaaaagttttaagagtttaatgagttttgctggcaatgtaaagtcatctctacaatgaattgacagtttctcacatttccattttaaaaataatgtactaacctttgtaccacaatattacaaacacataaatcaaagtgtagcatgtctaagaaactctggaagagaaaactctgcatgtgaaataaaaaaccgaatattgaaaccaaaaaatgtatttaacatatgaatgcatgctttaaaaagccaaattagaaaaaaaatcatttaataatattttacaaaaaacacattcattaaaggagctaggtatcctatactatacttattaaactcaatacaaaaagcaattttactgcatttatgaggtgatgggtaagcttatgcttgcaaatggattaagaatgtgggtgcactgtttacaatcatctcgtaataagacacttttatttttggtgtttaaatactcatcattgtattcatcattgtgatgtagacatgtaaaacatttcaatttccagcagttttaaatattttcttctgagtaaagaaggatttttgccaatgtcaaaataaagccctcatttttatgagtgattttagtagtaaatgaactaacgaaaactaaatcccaaattccaattcaaataaagcaaagcaacgacaaagtcttgaagtttctgcttagggtagtgcattaattggccccaacctgactgtccgtaccttgcagaaagtagagcaatatggaatatgttttattttatagaaagtgtcttgggataggagtcctgcaagagatgtgctaaaaccaaatcctactcaacctgcccttcagaaactacagtggagacccatgagaggacattaatctccatttgacaaccacgcttcacttcacagagtttaccagtcaagttttctttcccagagtctcaacttcagtggaccaagcaacacttgcttcagtggatcaagcaatagttcagtggtccaactatttccttttagtgtttcttttttacctactaacaggttgcaatttgttcaagtgccaagtactaagaatactggtgggtgtatatcatttttgataaactatttcctcctgacctaactcttctatttaacttaagagcaagtgtgaaactgtcactatggatatgaatgcattgaattctatctgttgtcttagaattttgggtatagtcttaaactgaaaataacaagtaataagtctctctcattctaagagatggaaatagcagggcatagcaaagggcttacaaaagagctgggaaaactggccctgcctttgttgctccaccatacccacttatactaaaactctctgaaggttttagaaagaatcggtcttctgaattcatggcccagagggagagtagggatggctccctctgtttattccgtaagggggaaaagaagatggtacttcaacctttttgtcccatgcaagtaagtggagctccaagaccactgatcacagggtctgggagtccagagtagatagggatgacacctaattaccaactctgcttctgaagatgtctgcttcagaaattatatgcctacttgataggtaaaaaatgaatgagaaatgatacagtgaagaaggggggcagcctgtactccccagtgcttggtgtggcaaacgtttctcaataggtcaagtgaacgtggaagaagacagccatgtttgagctatctaccaggaacactctttatggagcaagagtacctcaggatcaagaggcttgaagatgtttttatagagcatattttccttcttaaagatggggaaaacaaaagagcttctgcaagacttcttaaagatcccatacttgtaccccaaataaacccgaactttgtatctctgttacacacacacacacacacacacaaatcataaactcaaagctacaaatagctagttaacaggagacatttgcctattttccttaactcctacttcccaagacattggagaataatataactgaagtgcagttaaaaaaaaaaaaaagaaaaagaggcagtggaggtgtaagatggaatctaaccacacttgccttccagagaaagtcttttagaccatggcttaagcttgagctggaaacaaggaagcatattaaattaaatatgacattgagattttaagctgaacccaattagatttaagtctttattacctcagaggccagaaagcaaagggatctattcatggcgccatctacctggatgatgtaaaagcatttcatgtttctgatctatctggctgaaactacgcatcaaactactaacacagtccacgaattcagcacttactcaaataaagcaaaggcaaaggagaatgatagacatccagatcatctagaatgtggtccagcagaagacagaaaatggtttacgggaggtctgaagagataaagaacttaagaaatatctgtgaaaaatggagcattatagtagtatcacatgattgaaaagctaagatagatatgttgatgcttttgtctcatgcaactgcaagttgcatgttttatatccgtctaccaacatacatgaatataaataatccacgtgaaaactattgctcctgtcaaatgcaacaacttgcctactgattggtaactttgctgaacaaccaatttaaattcctgaagcataattctaaggtctttaaagaagcatgccataaaagtatcaggaattatttaaggaccactaagaatgttctatttgtctcagaaattggttcttacaatttttagttgtttagaaccggcaagatgacagccttaaagaagttgacacttcaggagatcgaaaccatcctggctgacacggtgaaaccctgtttctactaaaaatacaaaaaattagcctggcatggtggcaggcgcctgtagtcccagctacgcaggaggctgaggcaggagaatggtgtgaacccgggaggtagagctggcagtgagctgagatcgtgccattgcactacagtctgggtgacagagtgagactctgtctcaaaaaaaaaaaaaaaaaaaaaaaaaagaagctgacacttgaagcacacattgtattgtacacttgaaaaatctttgagattgattagataggaacactttattttccataatttcatatggtgttaagtaatagatcctttaaaagttatacaaaaatttccagatgtctagatatgcttataccagcttaatgaaatgttttccaaaaagaatagagttaggattttgaaaagggaattaaatggagattaagagaaaagcagagggagaagaggataatttacaacagaagaaataatttaccaatgctcatagctcatcacaagattcactttgttgctttctttgttttcaaattagttcatcctattttttcctaaagaaaggaggtctcacactgtgttccttggacaagaaagactaagtaaattaaaaccatgttgctttaacccactttaaatataactcttgtgaggggctttggtacagtggtttttcctgtggcatatttgttaatgtatttaatagggatataggcggtaaataattacaaagatgtgtacatgtctgcatatatatcctttaaatataaaataaagaaggttacattattcacgaaaggcttctagatttatgttttgttaatgtcactaggtttgaacacacctgggagaaaactcaaaagccgtgagcatggagctcctataattttctttaccaggaaagaatataaatgtgaaaactcttggtgtcatggttaataggaacttcacctgttttaggttttagcaggttactgaagttcttctgtgacctctgaaggaagcatacttgaaagtaacgtttgggaatcattttatcaatggaacttgacatcagatagccatcactttcaagtaaagcattgagcattgatagaatggtcaatgagctatagagtaatatatctaagacatttctggattcttgctgcatccatttatcctcatgggtagacaagtgaaattggtcttctgccctgacaggagcaaactgatgctttatttaagcttcaaaaagaaagtgaatgaagcattattcagtaaacataaaataagtctacaggattcatcatatccaagctttctcaaggtaccttcaggagccaccctaagtcagtgaaatttttccggcccaatggcgaggtactctttgactgcacatgtgttcatattattaaagtctaaactttaggcagtgaataatttattgatacaggaaataattaaaatatttaagtcgctgtctcctgatatggaatagtgagacagaatcagattctagggatgacttggtcagcattgagaccacatgttcaagcaaaatataaagtttatacatgagacaaaagtccaaatctggggataaaatcaagttggaaaagatgagaagtcaaaattagaaaaaatgtagctggtgcttctaagccaagtggtataggttaattagccaaatacagaagtacccaagtgagagagagcatactgaggccaattacagataggttggtggttgtgagcaaactagtccttacaatgtagatgaactagccagttgatagtcctcttaaataaggtcagtgatatccagtcagtacagtagtgtgacaaagatctcagagtgaaagaactttggaactcgttagtccctctacttaggaattcagactctcaggaaagaaactcaacacagcatctctggctttctggacttaatatgatgtatgggaagcaaattcatcacacttccttttatagaccaggtaaggatggccacacaggttgcctatgaataaaatagtttccaatcttcagtcaagcagtgtgaaatacagccttgataactagaaatggtgcttttctgatgtgcattagagatctctgctggattccttctactgtgatgtaggctcataatactctaaggccagtgttcaggttctcttggactacagtgccatggattttgccggcctctgtggtcaactgtaattcatattggttcgaacttgaaattgtatctgagcaactggaaaaatgctcctctctcctgggatgtctgggacgactggtcctttttcatcctacccaattacatgaagattaacaatatttatttatcacaaatactccagatgattgtcatggctctggagaagttgatgtgcaaggcacagtatgcttatggcttcctgtcatcttacttatccacactacattgaaaaagtcctcaggtctagctcagtcagtatctacattattgtgtcctaaggttattacaaggttttctaatattttgtcctccaagttgttaggatagacaagactgcagttttgtagaaaagaactcctaccaggatctttggctctgatatgattcatttggatgggatgtgcaccttgaacagcaggaacatggtgtatggaacagctgcttttccttctgctttcgaaacattctgtatagtgctttaggagtaggttgggagtgcagaaagatgactcgtgtgtttatatgagcatagggaacagataaacactggcagaatgatgcattacaatcgattccttgttacagactagggtcatctgccacaaaatgttcttacaatacattaagcttgctgaaatagaaataaactggttccaaacttcctctcttctctatgtcctcaccccacaatggcatcttctcatcgtctatagatgaaacccatcgtgctggaattatttggcatgggagaagaataaacaggtttccggtgtgacgctttaacttgtaggattgttaaacttgtcatacctcagatatagctgaagattaagatgtggacaatgcctacagccatgcaggactgcttagcatcttccccacaggaagtatctgttccgtcaacattgtggttcgggtgagggagagaggtaatatataatgaggatcctagtgatgccctttccgtgtcatcaaaaatctgctgcagtttcctagaaagcgttcattctacttcagcagggaactatggctgtgaaggaaaaccactttttcctctgcttggtttagttgttgaggaattggaaaggagcttcatttctggaatacagagatcatctatctgtcatgagcagtggttgggcaagaataaattactggtccacagtgggaatgaacctgacacataatgcaccttagcaaagtgcaccttatacatgtgctgataaaggtctatctagactggggttcacaaacctgaataatcatcagaatgaacttttccaaatacagttctcagcctcaattaaaatctactaaattagaaaatcagagggagtcaaaagtgggtatgtgtacaccaaagtccctatattcttctatctgtgtaattttggtgatgagctgaaattgagaaggtctatgaagaccgaagttagaaagaaaagatgtcttaaataacaacaacgaaaaataacaggtaagaaaatgcaatcagttgggcttacagcaaaaaagagcgaacagtagagtgctatgaaattggtattaatgctggtcagaatatacgaaacatagtgaggtagaaacagtaaggaaattctccaattttctttgatactttcaatgaaaaattactaataaatatatgcattttatgatttaaaagacagcatgatgaacttgaaaaatatttttattcctcattccatctagggacactggaatacactgcaaagaaatgttgtttaacattcccttttccatttatcattttttttaaaaaaataaacattttcagaaatttggcctgaatattaaataacagatttgattattcaatctcaagaatctatgaagtagcttgcaaagaaaacggttttaaaaagttgagagtggtaaaacgtaagatgaaagagagagatgaatatgtaccctcagaacagtattgtgtgttatagaaattaagtattagttgtcaatcatcatagataattaaagttattgacaagtttcattaacataaagatataaactcgaggaatttttctgaaaaggtacattgataaacttaaaagagaaacttcaatccaaaaatttatcactaaaatgctactttatcaatccatactactgatttagcttttacaactgattagtttttcggccttaatggttttcctttatgtattaactccctcttttgttattccaactttattattctttttttttttttttggtaggcccttgtagaaaagctattccaacttcagaagaaataactcaactatcaaattatgagatatttgaagacaagataccattaaatggatatgttaacactcattcacaaagatattaatgccctccaagagcaaacataatttgtctagagtgaatattaaatacttaaatattaatcatatattgaaatgcagtacatgattatatgtatacatatgtgcttatatacatgtatatataaatacatgcaagtatatatatgtgtttgtgtgtccctttgtgtctggaccccaaaaatgctaatattctataataggcatacagacgaacaaaaacatttaactactgttttatataatatttcggaaaagtaaatatgactgtccaaggaaacattattgattgaagtagggtaaattatatctaaaaataatggaattactacttacaaagaaaaaatccatgattcatggtgattaaaataagaattaaacacattcaccacagacccttttgtgaaggctatgtactctttcagttcctgtagctataaaatagagggtaactacatttaaaatacaagatgtattttaaaatattattaaaaacaagaatcaaggtaactcacacaattgatggtaggacaagaaaaatccctttctcaaataacaaaagaagatacatgaaatagagaaggaaaaatttctaatttacaaagaaaatagcatacacattcatgtctatttttcttacattaaagaggtctgggctattgagtttattatctatgtgtaaatattacacaagtgggtttcttcccctcaaaatgtaatcactcttgaccatttattcaattaatattattatgagaacaagttgcatagtccaccactcagctgaaaattgcagtcaccttgaacacagaggtctgccataatagtctgcttgcagtgcaatttttatataaagacaaaggttttttgcagagcattcaacctaggagaagtcaagattcaagatatccaatatcctttttactacttaaggaaagaaagccctgaattcaaagtatggaaagatgtaaacctagaagctatatccattattaacacactaagaataagattaaatttcacctttctaaatattaaagcatttattgttaattaattatcctcaatgaaatattttcaagtaatgataatctataaaagtgagcctaaattgttaactcccaaaccttatcaaaagcatttcaggtgtacaaataaccaaatgtataagatgacacccgaaattggcttcaaagccatgcaacctgtgcagttatgcagtaactcatgcttaggagagcccatgcttggtttaatgctctgctgttgccatcttacaatgcttaatttttgagtatgggacccagtattttctttcttccctgagtcccccaaattatggagccgatcctgacattttgggaaaaacagccaacagctaaaagactgacataaaaatctgaattaaattggttaagttagagagattgtaaaaaaaaaaaaaaaaatacatgaaattcacatttgacatactggcggtaaccagatgaatgacttgcaaatatgaatatagttggaagaagatacttcagactagaatcctagttgtttcagaatataatcaaatacaacctggagatgctaatcaaagataacgcaaagaaaaatcccttcgcttttgattttctatgcggctgtatgtgtgtggttctaaataaaattattttgcagaaaattacgggagaaagtcagataactgattatttccattgcgaataacttcattggctactactgagtccacgatattattctctaacacttctcctgattttaaacgaatctttaaaacaaaagagctcctattccaaatacttttcactctcatttcctcaatgacaccagttctcctttctcccaaccccctttaccgtgcagagtcctaaacaacctgaaaacagagttacctacttctcagggataaatttatccttggtggataaactttctcaaacttactactctccacctcagaacctccttgtattatctcaattttctctttcccacttccaaagtcaatccttccattttttttgctcgtgtatcctatcttgtaagactttgctcttatatattatgtctttctattggatcttcccttatactacaaacatgcttaaatttttattatcctgaaaatcaacaacacatcttttctgccctattactattcaatttcagttactggcctttctttctcattttttcatcatcacagatttattgtctctatttgccctgctcattttctcttttaccaaatcttaatctcacagttgttcctcctcactttggaacacagagactatatttaatgagagaaggagcaaagaaatacagctagtggaggcatcatgttagctgacttcaaactatactacagtgctacagtaaccaaaacaacacagtactggtacaaaaacagtcacatagaccaatgaaacagaatggaaagcccagaaataatgccacacacctatacccttctgatcttcgacaaagccgacaaaagcaagcaatgaggaaaggactccctattccataaatggtgctgggataactggctaaccgtatacagaagaataaaaccttacaccatatacaaaaatcaactcaagatgaatgaaagacttaaaatgtcaaagcaaaactttaaaaaccctggaggataacctaggcaataccatcctggacataggaatgggaaaagatgtaatgatgatgtcaaaagcaattgcaacaaaagcaaacactgacaaatgagacctaattaaattacacaacttcctcacagagttcctctgttgaactctgtcaacagagtaaacagacaaactacagaacgggagaaatattttgcaaactgtgaatctgataaaggtttaacatccagaatctctaagtaacttaaacaaatttattttaaaaactctactccattaaaaatgggcaaaggacatgaacacacatttttcacaagacgacacacatgtggccaacaatatgaaaaaaaatgctcaatatcaccaaccattagagaagtgcacattaaaaccacgataagatgccatctcgcaccagtcaaaatggctattattaaaatgtcaaaaaataacagatgctgttgggatggcagagaaaacagaacatttatacactgctggtgggggtgtaaattagttgagcccttgtggaaagcagtttggcagagctaaaaacagaacacagcaaccccattaccgggtgtatagccaaaggaatacaaattgttctaccacaaagacacatgcacacatatgttcattgcaacactattcacaatagcaaagatacagaatcaacctaaatgccctccatggtagactagataaagaaaatgtggtgcatatacaccatggaacactacgcagccacaaaaagaaggagttcgtgtcctttgcaggaacatggagggagctggagaccattctacttagcaaactaatgcaggaacagacaactaaatatcacatgttctcacttataagtgggagctaaataatgagaatacatggacacaatgagggaacagacactgggtcctacttgaggatagagaatgggaggaaggggaggatcagaaaaaatacctatcaggtagtatgcttattacctgggtgatgaaataatctgtacaccaaccccccatgacacactgtttacctgtataacaaacctgcatatatacccagaacataaaagtaaaacaacagctagatctgttgagaccatctttcagatctgctaagagaaaggctggtaaagaaagacaagaatcaaagttcattttaaaagttttggtatgagaaatttcaggaatgagatggcattaacagaggtggagaaaacggtgttgggtagctttgataggagctgtcatctgagtatgttaagtttgagtagcctatgagatatccaaagagaaaaatacacaatagaaggctggatatatggtctgaagttaagggcaaaagtctgtgccagagataatattttgggaataattagcatgtaaattttatttaaagccatgacactgcataaagtattataaagagtgaatatagaaaggaaagggagaacattaagcttaaacactgtttcatacacacttggatccagttggccaataatttgtttcagaacttttccttattaatttatgactgaaattggcatggggttttccttcctgtttcatttttgtctgattttggtaaaaaaaaaaaaaaattttctaaccttatattttccagacatgtatattgccttgtatgttctactgagtttgttgatgactggaattatctattcctagaaagtgtgttcaaatttgaatgtaaaataatttcagtctaatatagtctttgtaggaagacttttaatttgtgattaaatttctgtctcctcaggctttctatatccccttccatcatttttgtagcaatattctcctagaaattcatccatttcatgtaagtttctaaacttatttgcatagcttttagtattttctgtattttaaaaatatattataactgtagttataacattttcatccttaagattttatatttgtttttacttccctctcagttgatttgtctaattaaaacatgaatatgggcatttaaattttattgattccatgttgtttttatttatttctgctcttgaattcttctctttccatttactttctctgcatttattatacttttccctattttcttgagatgggcagttagctcactagttttcagcccttccgtctcttctacaaaaattaacaggaaccaattagttttaatttttatttttattatcactcggttctatgaattttaaccatccattttgaattcatctttgatccacaaattatttactttagtcaagtttttactattgattctagcttgttacaaatttaagagtatttccctaataataccaaatatgtgaaatgtattgacatttccatgtacttcagatgaaatttacactctgatttggggttctctatacagtctttatatccaccttatcaactgttaatcatcactatcttcactaacttttgtctggtgtcttgaaagaaagaggcattatgaaatctcccaccatgctgatatagttgtgtatttcttcttgttattctgtggatttttgctttacgtgttttaaaggtattttcccaggtatgtacgagatttttttgtttcttttgacagagtctcactccgtaacccaggctggagtggagactgcaatctcagctcactgcaacctctgcctcccagattcaagcaattctcccacctcagcctcccaagcagctgggactacaggcgtgcaccaccacagctggttaatttttgtatttttagcagagacggggtttcaccatgctgcccagattggtctcgaactcctgacctcaggtgagccacccacctcggcctctcaaagtgctgggattagaggcgtgagccaccatgcccggccaggtatgtacaagttttagaactgttatattttactccattttttgcctaataatgataatgaccataatgtctattttgctggaaataaattaggtgtctaagctttttattgattaatccttttcggaaaatctgtttccattttcgatatatgtgtctttatgtatttcttaaaaacaatgtattttgaattttgatgctttattctgaaaatttctacatttatatattaaatgtattgagcaaatagttctaggactacagatgtattttttttttctttttcttttctttccttttttttttttttttttgaggcagagttttgctctttcacccagtctggagtgaaatggcatgatctcagctcactgcaacttccgttccctgggttcaagtgattctcctgtctcagcctcccgagtagttgggattataggcacccaccaccaagcctggatacttttttttgggttttttttttttttttttttttttgtatttgtggtagagaccaggtatcaccttgttggcagcctggtctgcctgccttggcctcccaaagtgctgggattaaggcatgagctaccacgcccggccgctggtatttttctaccatctatttttttctatttctatttttctaccatcttttcttttattttatgctcatctcacatttttctgttttgttttccttctttcttgctttactgcgtactgattgagaactgttccttttatcattctttgattgtttcccaggtggatgctccattagtggttatccttgacaatttattacagcataaagtcgacatttaatcactatctctaccctctttctaaataaaagggcttgtggctgtaactcccctccatattgtttttaatctagtattttagatcaacattattttaaatgaaattagatattcttatatattttttgcaacaaatgccttttgtatttaaaagcttaactattttttcatcatacttattgcatctaaaacctttaaaacttatttttctactacttctaattcttcatacttattttagacatttttatagtaagggtctattggggtaaaatttcacttttttttcactctgataatgtctaatttcctcttactctgaagaactaattttgttgagttcagaattctaggttgacggtaattttttcaatatcttgaaaatattttccattgcttttttattcttattcattgttgtagataagaagtctaatgacagcctaaatttaattgctttgtaggttatccatctcacctctagctgctaatataaatttgtctttggatttctgcactttcactgtgatatgtctgagattggatttctatttatttactttgcctgttatataatgtgctttctgtttaagtggtttatgtcactggctcttggaaactttcctttaatatccttcatatattactccatctccatttctcaaaaaaattatgacatacaagaaagctgtatataattaacatacacaagttgctgagtttggagataaatatacactgataaaaacattacctcaatctatgacataaacctattcatcatctccaaaactttcctcctattctaatattattattattctgtaacagaacacttaacataaggtctatcctcttagcaaagtttaagtaaatagactaactataggcaatatgctttacagtagatctctaggaattatctatattgtataacctaaacattgtacccttttacaaatatctctccatttttcccttcccctagcccctggcaggaagcattccacattctccttccattagtttgactgtattagattcataatatgattgggatcatgtattatttgtctttctatgtctggcttacttcatgtagcataatgtcctccaggtttatccatgttgttacagcgaaatggtaggatttgcttattttttaagggctgaataatatttcattgtatgtatatatcacattttctttttcctttcacctgtcaatggacatttaggttgtctctatatctttgctattgtaaataatgctgcaataaacaatagagtgcagataatctccttgtgattctcattcaatttcctttggatatatccctagaagtggaattgctggatcatatagtaattctatttttaattttttttttgaggaatctccatactgttttccatagtgtcagcatgaattaacattcctgccatcagggtacaaggggcccttttctccacattcttgccaaacttgtcatctcttgattttctttttaagtaactgccattctaacagatgtgaagacatatatcattgtggttttgatttacatagccctgatgattaatgagtttgagcaccttttcatatatatgttggccatatgtaggtcttcattgaagaaatgccttttgagctcaactgctcatttttaaattgggttatataatttttttatattgaataataataatctccattttctttattctcctctttgaaaactcccattgagataagttatatgttcatattctactccccacccctgtatctattacctattgttcacatcttccacctccttagtttttggtaacacagtctgtacattctcttttagttttcttttaaatcatttctttcaactaatatgtttatatatgatatattcattttctaatttttaattgtagttgtttaattttgatttctttattccatttttacaatgttttcttttttataacttcaataacatttatttctataatattttacctatttattttatactatacatcttgcaattctaatatccggaattctagaagtaaactcaccgttcgttgtataggctgactgtgcttcatgagggcttttcttgtgcgtgtgagtgagtgtgtgtatgtctatgtgtttatgatgagctcaagttcccctgagtttaatctgtgaggacactgagggcacttttcatggtaaacaatttgcatttgcttctaactaatgctaggacgctcctaacctggtgctaccctgacttaatcacttgtttggatatttctttaccctttgtgataatatacactcaagagttcctcaccttacaagaataggccaacacacattttcaggtgacattattataattattctattactttgcactcacagtgagaagacagatgtctttttatgtttgttctctctgcagatagaattctctctgcccattatcttactgatagaaccccagttttatgtggaatctgtgtttagctccaccattttcgtgagccagaggatcatatttcttttccatcaaatgacttaattcacctaaaattggggttcccagtcttagcttttatctccaccatacaaatgtcagtggtcataggcatgttacggcatgacttcagtttcatctgatttttttcctagcctttaaaggtttacttatacttctttgaaagcaacataaaatacaactactagacattttccagcatcctagtgctttccagagggcattacagaagacttagctgtcctagcccttgagaacagaagtcagccctatcacaacaactgtgaagtaagctaatcaaatctatttcataaagcaaatgtgggatttaagtttgatgttgcttctaacggcttagcaaaaggactgacgtaaaactgtgctcaaaaagtaatggcttttactattattatagacagatattgtctacaaaacatattgacaaattaataaagcataatatgccacttattttcctagattactttatagtcttccttcaagcaatgttcttccgttctggtctatctatgctaaggtagatgtgacactgagggaaaaattcaaagtcataattaccaggaaaaattaatacggccctctctgagtctatcataaatgttactattacagaagaattaaccaatttagattttgtccctttcagtaaatttgctatttcatgtcaggcataacaacttacagacatctttgaaagggactgaaatacgggcattaataagccacgaaagaggtgaaataatcactcatcaagagaagtggtaaaggctttggacttctcaatgtgtgactttaatatttaagactctaaattttattttaattagtcagccataatacttttaaggccatgttttaagctttccttaaaaacggggaaactcgttaattgccatattcacttattagcagagtttttatttttaatatatgaaaagggtcacagagattggaggtagtgtagccaaatggtcacgtgcctaggcttcaagtgtaaagagatgggtctaaatgctcaatagctttttcctagggcctttaatatcctttcaatttctgtagaatgggaatatgaaaaaccatatatcggccggatgcggtggctcacgcctgtaattcaagcactttgggaggccgaggcgggcggataacctgaggtcaggtgtttgaggccagcctggccaacatggtgaagctccatctctactaaaaatacaaaaattagcctggcgtagtggcatgtgccagtaatcccagctactcgggaggctgaggcaagataatcgcttgaacccgggaggaggaggttgcagtgagctgagattgcacccttgtactctagcctgggcaacagggaaagactccatctcaaaaaaagaaaaaacaaaaacaaaaaccaccatgtatcataaggctattgtgagaactaaatgagaaaatgcatatctgacaattaaaagggtacctgagcctctgtaaccaaatactattaccaatattattattcattttgttgtattactaaatcatcttctgctgcttggttaccctgttagagaataaagctattacaatagttgtaaaaatgatatgatttggtacgtctgttggagatgttgcctggtttgctaaccatctttcaaatcattactgtgagtagaaaatatagtgctatatgattatcaagaatgaaagatgccttttgaagtgatggaaataatttattacttatttgaatgcaaactcacactctgaaattagggatgggatctagcaaatctcttttaaatattcataggcaataaaagtctggctgtttgactgatttaacaggcaattgaatgttaccttagttctgcataattgcagctataagaaacattaggtaggtgatataaaaacctcacaaacctctgacataggcacttaattgattttaaaaaataggttaaggctcatcttcaaattaaaaggcactttgtttattaatagcaaatctggctgaggcaggagaattgcttgaacccaggaggcagaggttgcagtgagccaagatcgtgccattgcactccagcctgggcttcagggagagactctgtctcaaaaaaataaaataaaataaaaatagaaaataaccacaaaataaaaacttttttgtttaaccaaccaaaaatcaagagaatcatggcctaaaacaaattcagaattcttgattataacacattaatgtacaacaagaattttttaaattgatttaaaaactcagttactgtaatcattttgtttcttcagcctctcagataatttatcccaaggcttattctactgcatcgaaacaacagtctttttaactagatagtggaaatatccaaaggattgatttagctaataaattattaggtgtgtcttttttacctaagtagtttgaaattgatcaaagtgctgagcaaagcctgagaaatacaaaagtcctattactacacattgttttaatttaacattgtatctttcaggtctaatcagcttatcacaggctgatacaacagaatttgagaaggatattatgtttaacatgatgtggttttcatgaaagccgtaaaaactaaatatgctttattttcattgtcaaataactcccaggttattactggccaaatatgtaatataaacacagctaggactgataatagtttcaagtttacttattttagatttattgttattttaacactctgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtactttaagtgccgtattttatattttgctcacaaaaaaaaccccctatgaaacaggatgaggaaacgtaagtttaaaactgttactcaaaatcacatagccagtgaattacagagggatttgccagttatcaattttttgcctttcaacatgatcctgtttttgacacgggaacatttctccccttgccagctgacatgatattaagttctgtcagtaaaggatgctggagtgacaatgggggaggtagaggtttgtctgtcccagtgtgcttttaattctttttcaaacctgtgactctgggctggcctatggaatgcccagtaaggctcacctcatccaccccactttacccagaagactttcagcaacactatgggtcgtgtttgacaagttctatgggtacccaataagcaaattgaggatgggtggcaaatccataggcagcttcctggagccccacctcatttcctcaagtttagtagcatccactacaggtagtttcccaccatgtccaatgaatacaccagacagctttctagcaaattcaatggttccccaccataggctacttccctgtgaattttgtcagcattcccctccaatattctcttcacactagcttcagctcactggctatagacttgttctggattgggtcaatgaaggaaacttctctgtcatcccatgggaggcagacacacactttctaaagaagtttgaatccagccttgggttgagctcctatctttccatattagttccttgtttgtgtactattcctcaggcttaaggtattctttagagatctcttttatttcctattaaaaattaatttccagtaagtagttaatacttatttgtgttaaaccatctctgtttaagtgactgagtggtttctgtgccctgtctggaccctgactactaatacaaggtgttattctagcccaagtttcaagtattttcttattcaaaagtttatgctttaaaaactcagtccagaaaataagataatacgtgttgaatcagggtatgttgctgaaatgaattattttttctttgggggaaatgtcagggtttataccaaaaacctttaaaatagaaggttataagtagttttgtgttaataaaggattgcaatataattacattaatagagttaataccaagatcaagttagagagtaagctattcctaaggacagaatagatgagtactgaaaaatgtcaaacactgaagttggatcttggccaggtgtatctcccagcactttgggaggccaaggcaagtggatagcttgagcccgggagttcaagaccagcctggacaacatggcaaaacaacatttccacacacacacacacaaataaccgggagtggcagcatgcacctgtagtcccagctactcaggaggctgaggtgggaagatcacctgagcccagggaggtcgaggctacagtgagccacgatcatgccactgcactccagtctcagggacagagcaagaccctgtctttaaaaaaaaaaaaatttgagtcttttcacagctaagccaaggtcagtttcacaatgacttttaattttttgatgcaactgctgtctcctacctgacactgatattcaaatagaaataaaaacacattccaattccatatcacaacccacattgaaatgatcttcaatttacttgccacatagcaatatctatttgactcagatccagcaatagtgcaacaatgatgaaggaccagagattgtttggaattccccttttccaatccccaattccttatgttgatttggataaaatatggatatgccacccaggattcaagactggaggtgctgctggtacatttgcagatatctgccctaccctcacatacttctcttcagaattggatagagaagaggttttcctactcaaggcgttccttttcaatctgtaagcatgtcaaaaggtccccgacattgactattcaataagtcattagtcaatggtttcatgcatactaccctagttactacccccccttattctcttttttctcttcatacgttatattatttgtttttatgtcttgcacattctaggaaatcagtaactcttccttaactaaccaatgtttttaagttatgaaggttagcaaatttttcctactcatcaaaccatagaaccatatctcacatgtagtagatgtactcagtaagtgaatataaaactaaacatcattataaaatgggttttcttcttgacaaataatccattcttaggagatagtatgcaaaacactgactaggagaaatttgctattttgttttagttttgatttgaaaaatcacaccatgtgtgatatatgaaaatttatctataagaaatgtagtgttatttatgaagaataaataatatggggtactaacagaattgcatgtattattagcagattacatgtgacataacaaatgtgtgtggaatggagggagaggaataaaatgagacagcgagagagaaaggatacccacacatactggtctatcttgagtaaggaaaagaactctgtggtcagagtaaccttcttgggatgtctcagttgccttttaagaatcctaacttacaatgtttttgtgaaatcacatgctataatacacatgtaaagaatttacccagtgtctggcattggattgtctctgaaacctgaaagctgagctaatatttaaactattgctcattttatctgagaggcctgtatctgctatacattaatgcaaattagattaaagagatttttcacttatcttcatacctcttcatgtagttccctccaacgagaattaaatgtctcaagttcctcattgattagctcatccatgactccgccatctgttagggtctgtgccaatatgcgaatctgatttgggttatcctctgaatgtcgcatcaaattttcaagtgactgaaacacatttgcaataattactatttctccttttttttctaaatacattggattatcagcaaatgctcagtatcttctgatttacatataattaagtcataatcaatttaaagcaaattttaattgggattaaaaacaccaaggagcatttttgcttcaaaaaataggatgtcattctatatgaatcttcatgggattatgacagtgttgcggactgagaacttaaaacttgattcacaaccacctttttccttgacgtcccctaactctaaaaccagaagaggtaaaacactaaatttctcaacttctctgatagctagtggtgtccacgtgacacaattctgaaaaagagtactctctcaagaagaatccttttgcccttcctacttttttgcacatacatggcctggaggtataacaatcatctttgcactgggaggcaatgactttgagtgtgaggtccttcatgctcaggaagagagagcagagagtgcctactcgcctcataatatggctgaaccatcctcaaccctgagtaacctcccttcactattcttttcgtggtgagaaaagatcattttgtgagcttaaaccgttgtctgattctctgttacgtacatcccaataatacccatctcctatactgctcaaaattgacaaagttgcctggctagataatatgatgaaagtgaatctcagtgtcataggcatgccagaaaacaagggattcaatttcatcttactggacctcaaacatatctataaaataagtgatgggcatatgttctcacaaatttattaaatcttctgttttccttgttttaaaaaaatgaaaatcttccaatacatatttgtaatttttcctgtttatgtatttttcttgaattttgagcaaactcaatacattgtcctattaagtttcaagaaaataaagagacttcctaaatacatttatattaaaaaaaatcactataacctgtaaaatactttaaaagccatcaaatttttgagtagaacaatgtgattgttaataattttcctaataatttatattccttattacttctaacaaatcttaattttgtaaatatttatttgcaaaatggatataaataattttaatggatacattattttataagtcttaacaaagtatataccttgttaaatttttttaaaggtggatgaaaagcaacaaagcaaaattaagggatcagttataaatatcttgagttgcaagaaaacctagaagtcgtgcagtttttctatccttgatacgtggtgatctagcccttttcactcaaaatgtcctcctggataagcatcagcaacactaccaaagagccaattttatgtatgtatttatttattttttcactgtggaatttcatttattggctccattatctgaattaggaacaatttgaaattatgaccacaacatagaaataaaagataagagcactcgcaattttcctcctccctgcttgtctgtgttgtgggcattgtgagggcctcgtctaaaatagtaaatagtaatggtaagttttgtttccccatcttttctaaatgctcttcattatggcttcaaattttctctctttccttaacattcctttgtgaacatgccctagtttttcagcacatcactgaaactgtgagagcaagaatttagcatggtgctccatgtacgatttgacaatttcataggctaacagcatcatcctatcttctgttctggccactgtccttttattaatgtgctgtaaatttgctgcaacttttctagaacatgtaacacattgctgattcacaagaaatgtttggtcaattaacttctctgaatacgacaaatttatagtcatagtcagatagagccaaaattaaagtccactggagatctacttcattgtactttaatatcttttcaggttttataatttccttttgaaaattaggaagttggataaaatgatctataggtgtctactctgatgttctaggattacaaattctattctgtctaaagaaataccttacattttcttcacatcttgaataatttatgctccttattttatagatttacagaggggctatactacttatagctttacgtacatatattacatattctaaaacaacatattcattacatatagataagtcaaaagtacactaaaatgcatagagcttgaatgattaaatgtcagaagttaaagtcaagtttataaatgcaaactcatttaattattgaaagtctccaaagtaaaacttaaaaatgtacttacattttatgaatactttaaagatatatttccaatattaaagcatatccatttaataactcaaaacattccgtaaggtgtaaatttgtgattttaagtaagtataaaataggttccaattcaatacgtgcagcttttaaactggaaataatatttcatattatcatcccgattagccctaaagcagtgagtttgtttattcacactgtctttgcaggtttgtggtacatttaattaggtgaagcatctatgtagaacttagtgatataataaaggcaaatttcctctgtgagaagccatttaaaccctttgcaaaatcttgtgacctagaaggttattagggggaacaaaggctttatccaaagtaccagtgctgagtgataacatagtaattatactctcttgggttgttttctttggatttgtcttctatttggtacttgacctcttttaatactgcatataaattatcatcatttggcttaatttacaacttacatctagcacctcagagatttcctcagctccgccaggaatgttttcagtggttttaagtttaaattctacttcatttagccacttgtttgctttctccaagtatgacaataactcatgccaacatgcccaaacttcctaagaaagaaatatatatcacagattaaatattatggtagaaaagtaaatgtgaaattttgccatttcattattaaaacttctgaaaatataacactttgtatttttcacctttactttgtagcaggtaattcaaaatgcagctagacagtttcatcatctaatacctctacaatcaaaagtcattaagaaaacattttattacatgaataatgaataaattcaaaagacagtaatttactttttaaaataaaaataagcaccaacattgcagtctgggaaacagaaaaataaaagcatatgtaaaaatgcatatgtaaatctaactccctcacacatcactgttaccagtattctgtgacctcctctgaaatttatcatatataatttgatagttaaaatttaagtgagtttaactatagctctcttttcactaaacattatatcataccattttctgtattactaagaagacatatttttaatgaaaatctaagacttctttaaagtggctctatcttagtttagcaatttcctttttttagatagactacttttagttttgtttgctattataaatttatggtaaacatcatcgtgaatatggactatttttccacattcttattatttccttgaggtatattatcggaaatattaccactaattcaaaggtttgattattttaaatggccattaatttgtattatgaaactgatttatacacagaagtactcataaaaaagcagaactttaaaatttctacaagaaaatatagaagaaaatatttctgactttggcatagagaagaatatcttaagtaagacatctcgtaaaaaactgaccgtaagaaaaaagagatgaatacattcgactacattaaaattaggaccttctattcatcaaaggacaccatcaagtaattgaaaaacagactcaaaatagaagaaaacaactgcaacatctgtaacacataagaatatgaaaaatgccagcaagtcaaatagaagatgaataacccaatcgataatgaaaagaaaacctgaaccaaaatcttaaagagaaatatgtatatacattaaacatgaagatatgttcaatctcattagtaatcaaggacatgtaggccaggattacaatgagataccatgttgattgacacaaatgagaagtttgacaattccacgtgtgagagaagatatacatgaacaaaaatttgtatttattgttggtgggtgtgtgtactgaaatggccatttcagaaaacaatttgttattctcaataaggtgaacattcacatacccatcaagacaacaactccactttttgatatgtgcatcctcagagaaactgtttaacatggataacaagactgttacaacaatgatcatttcagccctttttgtagtaatcaaaaaaaaggaaataatgtccactgcaaggagaatggaaaaatataccgtcatctttaaacagagaatacagacgtgacaatgaaaaatctcatcaaaaagaaccataagaatgaatctcagacacaaatatgttgggtgaaagacaaagccctaaaaaaactatattatagtttaccattactgtaatactgaaattaagcacaattgttttttcactcatatgtgtgtggattttttttaaacaaaggaataacaaaggtagctttctagatggtgattatgtctattggggaaaagataggaagatgcgagagaggataagaatgtaacaacggtcattttctgttagctttgtaactgttgaatgaacctataagtacagtaaacacaatgcagcaatcatcaccacttactaccacctgcccccgcctcactaccaccaaaattaaaggcttgaaaggaagatttatttcagaaggatctaaaaaattaatcagatttcccaaagttctctatgttcatagcccttagaatgacacagagtattcgatctctatctgatgaaaagtatcagtctcacctgcttggcaaacgtaccaacctttcatacctgcttgatatcttatgtacagtttattgcaaaaagtgaaattaagtgttttgctttaaaaggtgatagaaatctaaaatctgggtcatttccagctcctgctggactacaggctgtcttcattctgggcaaagatcccagtgggaaaatataaatatcttcttaaatacccgagggtaccttagagctttgaagacaaggagacgtgattggtaatgtgtcttattaactttggtgcagattgaggtaatgaactaccttgctgatttaactgtcagaatggatagcttcttctgtcctcaatgcatctgaaggacacagctggagaggctgaatgtaccagctttacaggtcacctttgcaaaataaaatatagtcttgaagcccgaattggagctaaaagccacttagaataactgttaagcttaacagtttggatcttaaaattactttgaaatcacagaatccaaagtggctttgaaggaaagtacaaataaaaaactaaacttctgttcaaaatagtagatggagctgatgaggtaactcccaacatatcctgcttcagttataccaaaatacatgttaaaatacaaaggaaacatttttaattcatagctgatctgtaaaacatgtatatagaacctcaggtgtgagaaagaaaaagagggaaatgaaagtagaaagtggaaaatcaagcttataaaaatactggcgtatcagaacagggtatacgacatcaaagctggggcatttaacactaacttgagatgggaaatgaggcaagccagggaaatgggaaagaatgaagcagtgtgccatccaccctgtaaggaagaagtagaacatccctagccattggaatattatgatttagcaaggaaactattgttgggggattttgggctgaaaaataaagatccacccataacaaacggaaacttaagcttgtatcacacatgagggcagagcataaaatctctacaatcctgatggcaacaatacaaaaactcaatagcccagagaaaaaaaaagacaaaaattccagtaaaggcaattcctattatagatgagctcgcaaataaacaaataaacaaacaaaaaccttactagccacatggggaaattcacttccattagagggagtcattagttgtaacaaatggtagaatccataccttatgacataaagataatagaacaattttggagaactgtacaataaatatgcctagcctcatggtgtatgtttcccatagagtttatttgcttgagactggcaagtggaattcacacctaagaaaaagggcttggttgcctacatttcattttgggagatcatctctttcttgttttcacaagccctggtttaaacagagagagctgacggagacttgaggggagtgaggtgaagagagtttgaatagttaggcaattcttctttctcacccttttatggggataggtagggtaaactcatctgaatcattttatttacaggatctaaaacaaaaccactcatctactgggtggatatattcaggaaggggtggttggtattcatttcctgttgagctgttggtatggccaagaaggaatcaaaaacaactctttcaaacttctcattcctgaaaggtacggagtataggtacttccagtgcccataggctctgagttgagatatggtaggtaaattagactccagggcatcactaaagcattggttaaaaagacataatattcaagagcagtttgtgtaaagctgttgacaagcgtcagcttgaaattcttgttaaacactacgaggtactataaaagcctaggagatcttttttggggggttcaaagctcatatgaataaggccaatctggatcctcaacagagcgaatcaagtctatagagaacgagccaggtcagtggtgataatatatagaagagggacaacagactaggcattatagatgtgtgtgggttttaacaaaagggaacagcagttgtgagcagcaaaaaaaggactttcacatgaagagagtatttttccctcttcaccctcccttatatcgacagtagatctgtatccagaaactgggatggaggaggagactgtgagaccatttattctcactcctgcgtctgtataaattgctgaagcaacagattaatctaaacttgtgaaatatttgattaagttatgatatttaaatttaaattagagtacattttaataactaaaagtgaataaaaagtaatgagatcccagagaaatattgttaaagaagccaactaccaggcagaaggtgaaatttgacagagttgggtgtagttattggaaaaataagacggtgtcatgtttattactcattaagttgaaacatttcagtcaaacagatggtatctgtttaagttgtttaaaggaatacatagaattaatcacaaaaaagaagaaaaccataacaaagaacagatttgtgaaacaactcaataaaatattgagaaatggaaaatatgttttttgaaaaaatataaacacacatacataaatgtagagagataaatatatatacagacaaagatgagactatttctctattgaaggataaattacgccacaggcagctgaagcgagaatttgagagttggaagacagattttagaaaagtatccaaaattgagcagatagagataagaatatagaaaatattaaagggaaaccagtaactggaatataagaaggggatagtcttaatagctctaagaaagttttcccttaggaaggaatgaagagattgggaaaaagaaaatcttcacaaagacaatgcagaaccactaaagaaataacgtatctgttctaattaacacaccaggtgacaaagtataaatgaaagcaaatttacacacagacaaagttgagtgaaactgtagaagacaaaatagggtgaaactgcagagcagacaggacgaagagaaaatttaaaggtaccagagaaaatgataaagaaacaataacttgacagcagatttcctaaaggcaaaaaatttcaaaagacaaataatattttcagtgttgtaggaaaaaaaaaaacctgtccttacataatttcctgctcaactgcatcattatccaatactcagggcaaaataaaggcattttcaatatgtaaaatctgaacacatttgctactcacactcaaggaaagagcaagaaagaaactgaacacagaagcaaagggaagaacaaaaggcaaaactgatcacaaaaactgggaaaatagcatcggtaaatctaaataaatattatatgaaatagttaaaacaacagcagcagcaacagcaattatatggactaatttgggggaaataaggtgaaaatgaaatatgaggcaacaataacgcggaaaacggaagaggtaggttcagagttaaactatgctaatgtttccaccatattattgttagagaggtatagagaaatatttataagataaaataaagtacatattccaaaccagtgaaaaaggactaaaatggaactcaataatttgataacttcaatatgaatagggaatgttagaaatgttattatacatgagaaggaaatggaaaaataatccaataattggtcttgaaaagtttgttattaatacgaaaacttaagaaaatcccttcggaaaatgtactccaatataaatttctaatgaatcacggagtatcatttaaatgaacaacatgaataatagggaacaatgatgcttatttaaggacattaagaacataagaaagtaatagtaggtgttttatttaaacattgtcagaaagcatttcctgggtacaaaaagtccctccctattgtaacatgttagtgaattaattgtggttttcttgagacatgtacagtgccatcagatcccttcccttcccattctttgttatattttatatagcactcacataacactgatacataagatacgtcattatatcctcagaaactgtaatatttcctgacatatagaaggcacttttcaagagtctgaggagtgaattgcatttaaaagaaaagaataaggatgagtaaagaagagcttagaactgataatggagaaactcggatcacattttacaattggaaaatgataatactgtattgggaatatatggggtactttagctacaaatacattttaaaatatttttaaaggtgtactttattattgatctgaatcgtatctttctttaaatatcaaaccctcaacataggaagcaaactaaataatgtttttcaaaagtaaagaggtacctgaacactttattaaccatattcaccaaaataactcagtctgtgtgagggaagggggcttaaagtccaactcatgtgcaatgtctggcagcatcagcatttgtagtggataaagttttgtgccccttggcacagtattttcataagaaaggtcatagcttatttttgatgcaattacatggccatcatttgaggcacctgctttctttatctaaattcagataagcataatctagacagtaaggcccatccataaaagttaaagcagaagttgtgataatacataaatataatgcaaaccatcaaaaaatatagagctggttaggtaacatgtctaacaaagaactctatggggcacggcaattactaaagacaattgtagtaaaaacatacttctctacagaatgcttttccccaaagatacttaaataagtttatgtacatacaaaaataagaaaaaataaagatcattgtctataaatctggagaaaatttataggattttatgacctaataatagtaatgagaattagaagcatagctactcacatatattgagtactaggctaagtagtttaaagagaatagctcatttaattttctcaacaacttatgaattatgtattatgtctagttgacagattgaaaacaggtttacacaagttaagcaaatggcccaaagtcatacaacttataagtgcctgaatgaggaattcaagccaaagttgttttgcactggtatccatgttcttaaccactatgcctcacatatgaccatgtattgacatatcattgacaaagaccaagaaaagcaactgacttccaaagtcttgcatttcccattcagcctagtgcagagccactggtagttggtggttagagtttcaagttccttttttaaggcctcttgtgctacaggtggagcttgagctatgacactatttacagactcagtaaggagtttcactttcgcttctttttgttgggcctcttctttagctctctgaaaaataaagaatgctctcttaatagcatgaaaataactttacatccaaaatgcatttctatgaatcatataatttctttctcacaacatcccagttagaatgagaattacaaaaataaatctaatatgaactccagtctcttccataaatttaagtttagttgaaattggaaagttaaagaaataatttattataagaatacaacagatctgtaacaagaatagactgaaaagtagtctgcatggaggtatggatttgtggtcaaatatatacacattgatataaatacaattgtttggaaaaggcaagaaacaaatatttcaatattaactaggttaaaaaatatttggcagtctagaattgaaatcacttataaattacttggatgaataatattgaaaccatcacaaatatcattatttaagttaaaggatacttaacatagaaaggtccccttgatgctatatttaggaacatattttgataaaagaaagtttcgttcgagaattgaaaacacatgagagaaagagaaaccaaaaaaggagctgctgatatcagaagctggcctgacacccagctatgccttggtcttctcaagtggaaaataaactgtttcacagaatttcaacattggaaaaggccactttgtttccataatggatcaagaccatgacaagatcattccataatcatgtctgaatccagacaaaaacatcaacattacccaaaccacaaaacgcccaacactctcctatcctggttaatatgaacgaacgccgtttctttattaattgcaactttagcctcattctggtcttctctccttctggacaagatacgatacccatatagctatccctacacactaatgacaagcaatccaaagtaaagcttttaaaccctccctcaaatcccctaacacaagcacaaatcctacaatgttttttttttttttcatccacacgcaccccctggcctccatgttgtgtattctccctcattgcaaaaaataatgaacccaacttgttcagctacaagagagttggtggtggtcttcggttgggagacatttacactccttaacttcaaatgcgtacatgtattttagaaacacacacacatacacactgtatctttagtctgtgttcctccaggggtcaaacctgacattagctttcaaatataagtagtttatttatgtgtgccatgtaaaagaaattctggtagctgaatggggaattgagacaagaaagggaagagacatccatatgggcatacttattaatcccagcaaacactgttaatgactagagtttaatcctgttagaaagccctgagaaatatatgcctgcgggttatcccattcaggggtgaagaaattggggtattatttctgtatcatcttccctaattgttaaaggctgttggggaaatgttaatttcccagtacttgcaagcctaccacacaagtgcaaaagtgggattcagtggccacagaaagccctcaagtaaaggaactcaggttctataatgtagaagttgggcctgcatacaatgcggtggttaaggtaagggcttattggcaggatatggataaggtcagctataaaatgcctttgtatgtgtcagcataatcaccctactcctttggatttagtcccacaattccttaaaagtatgcattatgtcagaaaatgcaaattgttttgtctatagaatgcttaacttcaccgattttaattgattgaaatctttagttcaatattctaaataaatcagctttttggcatcactgagcatagagattgtttttacacaaattgcattttgactttagtaattatagtataatcaacaagtttgattaccattcatcatttaatatgtgctactgtgttctgtgccagccatgtcataagtgctacctcattagatctttacccaaaccttctcggatgtgttttgttacctctatattggacattagaaaactgaggttcagagagtttaaggaaatcatcctcagagttatatcctctctttctcatagtttctgttaagcgggtctcaaatgttccatgagctgaagaaggagcatgctgtagtcagtctaatgaataaaattacaatttatgctcattataaataacccaagcaactatataaaaatgtagaatgaagaacacttctttccatggtttttagacttcatatattcttggtttaataagaggctcagatcttgggaaaggttcgaagaacaaacagcaaaatttattaatccaggtacatatgaggaaagaagatgatgatgaatttctctactaggagaaaaggtagaaagctaaatgactggtacagtttctatacaaatcctcataaaaacggtggctcttgtttctttccatgaatctaactatgatatgctctgccatctttcattgctaggatttcacacccgtgcttcttaaagtgagcacccttggaatcactctgcaacttgttctttggtatcaaactcaaacttgttaaaaatgaaaaactacaggcctcacccaagactcactgaatcagaaattctggggtcagggcccagcactctgtgtattaaacaagacttccaggtgattctgatgtccattcagatgcaggaatcactgctgtagtgattatacaaatttatttgtgtatttactattctcactttatgtgtaagttctggtaagcactagtactagagttataatagagtaaaaattaaaaaaaaataaaaccagttaataactttccagagtgtttttcaaagggttttagtataaagttttaccatatagtgattgctgatctccataaaagttttaaagtcagaggttgtttatcaaactgtaccctgggttcttttatgtcaaaaaaactttccttttcaggggaaaaataagttattaaaacagcacttccattttcaggtaaaacacaggaaagaacataaacagaagggggggtctctatttcttctttgagtatcagggagagatgtcaaaataggtctgttagtatcttctgacaataaagaaaaattagctatcaaatgagcacaggtagaagtctggacaaggtactattgctaacctccaggtagtgaagttgccttaaagaaactgtcttgagtagcaggctgaaaactcaagaaatgaaatcttcctgccaactcttccagtggttgttgccagaggcttccagagtttacctctttttactatcacccccatactaaaccaattttgtagctagaccaattatcaaaacatgtcaatcaatgtagacaaatttgttggaacactcatttcaaggatggttttcaaattttaaaaatttgagacagtttactctagagcacaggaaaataagagagatctgactgggttgttggtgacataggcaaatcgctcatagggagagggaagagggccagaagaggcactgaaccaaaggaacccagggataatcagagcagctgaacacaaatgactctatagtatctacttacggatctgaggtagtggccatatataaatagacgcagtgagaaaggaattgagatacaagagaaaaggccatatgagtgacacacaatggaaaagaaaggaaaggaaaaggaaagggaaagtgaaagtgaaagtgaaagtgaaagtgaaagggaaagggaaagggaaagggaaagggaaagggaaagggaaagggaaagggaaagggaagggaaaggaaagggaaagggaaagggaaagggaaagggaaagggaaaggaaaggaaaggaaaggaaaggaaaggaaaggaaaggaaaggaaaggaaaggaaaggaaaggaaaggaaaggaaaggaaaaaagagatgaaatagaataaaataccttcaatcctgtgggctctaccacaaataaagtctgtgactatggctaaatcatttgacctatctgggaattgcagttttctgataagcagagagagaagtgtgaattacacaagtttcaaagtaccttctagctctcacattctgataaagttttcctcaggggtgacctccccaaagtcaaattttaaattattttggtcttttgaaatactccaatggtttttcttgtccatttagaataaaaactgtgatactctaacaaaacccgtttgttaacagatatttgcccacctcctaagacttatctgaggtaattttatcccattttccttccttcaggcagatttctttctcttcccaattagcttcagggtctttgcagaagctatgctctctgaatagaatgtgtttccataaagatttttttaagtggttggcttttccttatgattcagttctctcatattacatacaattcttcataaatgctctataagtcaagtttttctaaaatagcatcctaccaccctcaaatcctgcctgaacattattcattcttgatttcaaaatccatgtttacttctaggcaaattatcatgatttcatttatttttccatttattgcctgctcctcaccacacgctagaacactagaatgtaaattccaaggcagtggtcttgctcaccaccctctatattcagtagccagagggtgtttggcacacagtaagtatgcaataagttttagttgataaatatgctattgctagattagaataattctgtgtttttaatactctagaaatgattatactaattttttcttcattatagttttatacacacataatatttatacatatttatggagtatattagatatttactttcaacatttgactaaagccgtatgacagattcgatatttaaacatctgagttttcatgtgagttactttctgctattaactataatagatatttctgaattaccatttaattatataattttttaccatgtggccctttcacaattaaaataataaataatgagtcatggtcatttatactgtgctaggcattgtgttagaaatttcatatttcatccctctaatgattctgaaagcagacattctgatacccagttcacaaacgaaggaatttggctcagtaagctcatgtaactcaccccaatttatacagttggcatggggccgaactaagttttaaactcaagtatctggctccacattgatttttccttgtcacaatccttgaaccaaaaaaagatctacagtattaatatttcaagtcattctctaagttcttgctagcacataaaaataataattatgattatagctactaattgagcaccaactctgagttaggcaatttactcacatggtagttacaatcaacagttcatacattcaagtgaggaagtatgatgatataaacatgataaaacagaggattatattgactattatattgttgcccaaggccatacgaaatgccactatgtaggttcaagtccaggcttcacctccaaatccatactacatactacataccagtttccttcgtaataagtcaatgttatattttgtcctattgtttcaagaaaagtacatgtaaactcagtcctttctatccatattaaaggctacgggttcaaatatttagtgtttccaaattctcagaaatgccttcaaactaccaaattaacacagtttgttgactacattataaatttgtcttttcaagaatacttttgcacagtttcaacgtacatttacatcagctacagacagttaatgaaatgagttgattctgctctcttaatactacatgatttcaagggaaaattgtttcaaattgtgattttcaattttcataattgaccacaatgcattaaaattaaacagtttaaggttgttaaaatgtatattaaacttgaagctaaattaaaattattaattaaaaatcaacctcttctcttagaaccaggaaagagcagactgtatacaacttcaagcattgttgcatttctttctttttccatttatttcctttgttttacttagtttttctttttttttttttaccttcatctcttcaactgctttctgtaattcatctggagttttatattcaaaatctctctcaagatactcttcttcagcttgtgtcatccattcgtgcatctctgatagatctttctggaggcttacagttttctccaaacctcccttcaaggcctcctttctggcatagaccttccacaaaacaaacaaacaaaacacgattattgacagtgatgaaacattattattatattatttcatcagtatgtaaataacagaaagcttagatagtaatgataaagaagtaaaaagcttatatgcataagaaaataactcatggggatcagatacactcaatttcccataagtgtgaaaataagacatgtctgtttatttggcatacttaataaaatgaacgtattgcccgatgatgataattcagctgtttgtgtgacaatgcttttctgtgaatggagaaaaacaaggctttttaaaataatatgtttcagttggaaaagtaattttattggcatacatagaaatagttattctttgtgttctttcataatgttttactattttaaatattctaagaacttcataatcatgtatctacagaaactctcataaattaaaaagaaaaaacgaaaagtgcataaaacgtagtttggcaattcacaaagaagataatatatggcaatacatgtatataaaagatgttctaataccatttatagttaaatgattgcaaatcgaagtgaattaatgcattttcacatgttaagacagggaaaaataataattaataaagagcccattttgggcagggatgtgggaaaatcaaagtttttatacttgttgagggaaatatccaacataatacaaccttttagatagtaagatggcaaaacatataaaaatgttaatgtccacgaatctgagtcaactgctccattttttgagagtgaatcatgccaaccaaagtgtagagactaacatgtacaatatttaattcagctttaaagaccaaacatcttgaaaacaaacccaaaggtgctttcatgagagattaaattatgacatatatatactatgggatactgtgcatcacaaatacatctttactgaaatgaaaagtggctcaatataaagttttacgtgtaaaatgcaagttgcaaaagagtctgtctgtggttatagaaaacatctgctatttaaagcctcacgcatttttgaaaactaaaactttctacaatggactccattactcattaaccagaaaaatgcaaaacttaaaacatctaaaagaaaatcatacaccttgttacaaggcactctatagtattacaatcattatacatagtgcttttactttaaaaagtaactctattcaaaagatggtattcttctctctggttgaaacaacattatacattttaagtaacagagttttcatagtattaatatataatgcacagttttagtaaaatgaagtgttcatggtactttgcccaatagtaaatatgtgtagaatcactatcgcattgattttccttataatttacaaccattttgagcctaatatagataatacttcattttaggttctttacttacctaggtaaatgtagtacttgatctactacaatgtaaataaatgtttcaccctaacacatctagaacaatatgtcttgcaattgtactagaaaaggtataaatgttattttgtgcagtcaatgaacctataataaacttaagaaaacatgctgctatttttgctattttataaattaagaaatcctgctgctaaatttctacttagaaactctgctctgttataatcttttaaggcagttggtgaagctacaaaaatattagagggactaatggaattcagccaagacttctagtaaaaactatacattcacatacatactttgtgtgtgtgtgtgtgtgtgtgtgtgtgtgtgtgtgtgtatgtgtgtgtgtgtgtgcacgtgctcaagtatggtgagatattgttggatcctggaaattttgaaggcaaaaacgacagcatttggtgatagatttgatgttcggctgtaagagaaatataggagacaagaaaatctcgtgggatttggcttgaataagtggaaagatggaggtgccatttgtaataacaggcaaatttctagggtagtagactggggtatacatcaggaattttgttttaacatgttagatttaatatgcctattattaattgatgtggaggtgttgagtgggcaaatgggtatgcaggtctaggatcattagaaagggtccagattgttaaaaaaaaaaaaaaaaaaaacttacagcaggaacaacttacagattacatttaaaactatggagcttgataagttgacccggagagtgggtggtaatagggggaaaaaaaaaaggagtccacagactgagccctggaacactttcaaatttagtggtcagggcaatagaaccaccaaggatattgacagtggtcagggaaaactaagagataattaagaaagaatgatgacacagaagccaactgaatttagcgatttagtaatacgaattcactgatgaccctgacaaaatctgctttaatagaatagtgaggataacagtttgattagctctcttaattggcatcaagagagaagggaaggagtgaaatggagagaaaggaatgtctgtaaagggaaacgggaatggagaggttgctagagagattgttgtccaattgaggattcttttaaatgacaggagatattacagaataattctctactgatgggaatgatgggaatgatgtagcgtggagaagatgtaggaggtagagggctgttcattagctgttacaatgtccttgtgcagagacaagggaaagggatccaggtacgtaagtggaaaagctggccttagacaaaagcacagaaagttcatctatgtaaacaaagggaaagtagagtctgtgagcttatatgcaggtcagtgggagtactgcaacttctattctgattgcttatattttctcggtaaaacaagaagctagttttttgcagaaagatggaaaaacagactgttagagatctgacgaaagagatctggggatcactacacccaaagagtatactgacccagagaaagacaatgatctgcaagctggcagaaagacatccacgtaacctctaaatcccatttattgataactatttactataaatttaaagccactaataattaaaatatataaccatatattatttacttagaaagtatacatgttttataattctatatatgtaggtttctatttgttttctatctaacaaacatgtacagtgattaatctaggttagatgaggctctatacaccttgaaaagatgaattcatttaattattatatacttatgaattatgtattaatatcatcacattttaaagattgggagactcaagcacaaaaaggttaaacaacttttctagaatcacacaggcagtttatgatgtggatagacttaaacccaggcgatctgatctcagagcttctggtcttacacactgtgcctttccatccacaaaaaaaatattctccagtatttgaccgcgtgtgtctggtttatttcacttagcatactatcctccaagttcatctatgctgctgcaaatggaagaattttcttttttaaagctacataatattccgttatatgcatataccatgttttatttatttgacaatatacatttagattgtttccatgtcttggctattgtaaatattgctgctgtaaacataggggtgcagatacctccttgagatcctgattttatttcctttggatatatatccagaagcgggattggtgaatcaaatgggaattctatttgtaattttttgaggaacctccaaactgttctcccaaatggctgcaccaatttacattccaaccaacaccataaaagaattcccttttctccacattcttgccaacacttagtatcttttgctttgttttgttctgataatagccaccctaacaggtatgaagaggttcttgtggcttttaactgcatttttcagatgattagtgatgcaccttttcatatacctgttggtcatttctacgtattctttagagaaatgactattcaagtcctgtgctcatttttaatcaggttatttttcagttttatttttgctattgaattttagaagttccttatatattttggatattaatcatttgccagacatatgatttgtgaatatttccttccattccctagaatctaaaatagtcaaactcacagaactagagagtagaatagtggtttccaaaggctgagagaggggaaaatggcaaaatgatgcccaaaggatacaaagcttcagttatgcaagatgaattagctctgcagatctactgtacaacattgggcctatagttaaaaatactgtattgttaaaaatattccaagaggatagatcttaggagctcttatcacaaaacaaaaaaaataaataaattaaggggcagaaggaaacttttggaggtgataggtaagtttatcatcttgaatgtggtaataagtctcatgggtatacgcttatccccaaactaatcaagttgtataaattaaatatgtacagcttttggtatgtcagtcatacctcaacaaagtggtttaaacaaaaatagattctcttccatctctaagagtttacgaattatccaatttgaccaagcattttagggatgggagcatggggaaatcttctcaataggcaagaaacagtatcttatatacatgttatctttatttttatgtacctcgtttatatgcccagtttgaaaagtgtacttgacttccagatacatgtctgattgtctttttctccgaaataaatatggctaagatggaaccgctagtcactctagtaagctattccattttgttcttctcttagtacccactctttctttaaaatcacaatgacctacaatgtagctcataacagaaatatatctgaaaacactttgattcttccctcattcttcctctagactatcaacaaacactctccttcagcaagtactgccagatctaatgggatctgttaaaaagaataaaggaatgtgtcatgttaggataggaataatacttctgggtagatgtaagtgtgaaagtcctcatcaaaaatgtaatgaggatactaatcctctgttggatgagtagtttgcaaatattttttcccattctgtggattgtcttttcattctgtttactgtttcctttgctgtgcagaagctagaaactcagatatcataaaaagaaaaataacgattttatgatataaaacatcatatcatatgtggatgtgatgggattcaaaaatgggcaaataatctgaacagttatttccaaaagaagaaaaaaatggccaattaatatatgaaaaaaaaattccacatcggtaatcatcaaataaatgcaaaccaaaaccacaatgaggtatcacctcaccccagctaggatgtatattgccaaaaagacaaaaaataattgttggcacggatgcagataaaaaggaactacactacactgttagtgggaatataaatggtacagtcactgtagagaacagcatggaggttcctcagaaaactacaatatccacaaatatcccctttttcctgcctgttttttttttctacctggacaattgcaatccctacctgcttccacttcagcccttttgatttattcttcttctaataggaatatgcagcaaacttaaaacaaccattttaaatgaaatgaaatgatgccactcctatgcttaaaagtcagatgactttccaaagtacttgacataatgactaaatcatcactgtggcttccatattcctttctgactcattttcccactctttttctcctggcttcctttgagctcctcaaacatgctaagccctctcttgcctcagatgttttctccacttcattttctggcagaattccttgacacaacaaattgtcaagttcctactactcgggtatcagctttaatttcgcctcttcagaaaacactctactgactacccaatagaaagtagttttcctgctcctgtcactctcatttaaagggttcttattgctacattcagagtgtaagcaagacttcaaacaagacattgttgtgataatgtgttaacctatttactttccattttcaccactaaactattatctccgtgaaggtaactacaatgtctattttattccctcacttatatctgatcatttttttagaaatagctagaatctagatttttaaacttatatacataccctttaaaatttaaaataataaccattttatatacccaaaattagatcatgggatgtgaaagcatcttcaaatgtatcagatatttggacaattttgtttcaaattatttatgttttcgcagacattggcatctggtgacaaaaaaggaattatctttaacccaaaagagtgtatcacacacttattttgtctgtagatatttctgtaatgcatagatttacacttcatttccattattctctctggaatgctgaattggtaacaatattcacatatggcttccttgtttttaccgcatcgtcttcttcttctccttgagcgccattgttccttccttttacaacctaactcatttggctacaaagtcagaacatggccagagtgatacttgtaggaaaagcacagatacatataatattctaagattagaaaatggagatcagaacatagcttggatctatagcttttttgctatgcaacagatgagtgtgtttaaaatatatctcttgaacaacaaattcttagtacatataacagacataaggtcttaagcaaagacatttttagagagcctttacaaattgtactcctgtaaaatgtaaaaaccttgaggttttagtaatattgttggttttatactttttttttttggctgatgttttccccttgctctacataaattggtgatgttctttttattcatccattaagaacattcaacaaacaaaaaacaaatacctttcacactggccttccaggaaaacatcaatggtataatctattatttaagtaatattttttttttttcctaaacaactcttctagcactgacttacttcaggagaagaatgtgagctagctgacccagggacagctcatctgtgaattaacagaaccaatgaacacttgtcagtgattgtattagctgagtgatttcccttgacttttctaattttttttttcattttcaaatgtagcttttgccttttgacattacttcttttctattttgaaagtttacttagcagtaaccaaagaccaactgcctctaacacgtaaattgaaaccccttattaatttccaaaaaggtacagtagttcccttgtatctttggaagatatgttcataccaagacctccaatagatgcctgaaaccatagatgatacctaaccctatatacactagattttttcctactcatacatacctataaaatttaatttataaattaggcatagtaagagattaacaactaataaaatagaacaagttatctctcttcttctccctctcaaaatatcttattttactgtgctcaccgattttaggattccaattgaccacaagcatttgaaaccagggaaagcaaaactgcagatgatcggggactaatgtattggtgaacttaaaagtattcattgctttagttcaaaattttatctttcgaacaagaagtatttgatatacactatttttgaatatatcttactatccgtaattgaatatttaaatataagagagatatctataaaatattcttctgtagaaaaatgagaaactcaaatatgagtgtacagtcattttgtgtgtgtttttttttgaaattcagctattcttaatggttactgaatcttaattgttatttaaaactagatgtcagccaggtgtggtaactcacacctataattccagcattttgggaggccaaggaaagagcattgtttgagcccaggaattcaaaaccagcctgggaaacacagcaagaccctgtctctaccaaaaaataacaaaaaattagccaggcatggtggcacacacctgtacttctagctacttgtggggactgagatgggagaattgcttgagcccaggaggttgaggctgcagtgagccgagttcacaccactgcactccagcctgggtgacagagggagaccctgtcccaaaaaataaaataaataaataataaatgtgtcgaagaggccaaacttggaaatgttaatcgaaagttataattatttatcctatttctacatacacatatattagccatgcattttattttgtaccaaatatctccgtgtaacaaatttttcttaatcccattattattatacatttatgttctgaagaaaacatggattggaaataatgactaagaataggatttcattttttagtatgacagttgtgttcaagaaagtcattttaggatcaaaataagatgaatgtgtactatttaaaatatataccatgaaaatatttagatatgctagaaaaaagattaatttgtcagaattaattgtgctttaaagcaaaaacataggaacaaagccttaaccaaaagtaacggtgaagggagacattaggaaatcttagttaagtacgttgaggcaagccacagtgaaagagattgtctatacctgttggcacatgtgatcccactgagtgttaagttctttgagttctgtctcaagtctcgaagcaaactctggctctgcttcattctttatcttctgcccaccttcattgacactgtttagactgggctgaattgtctgaatatcactgactaaaagctaagaaaataaatcaatttaagccagctgaaaaaaattactgccacatattagatatgaaacatagctagaaaatgtaaaattgggactgatggcattgcatatggatttttgtcttttaaaatctgagatacagagatattgatatagatgactgcctaacagtcttgcaaaaatgttcaatggttattatggcatgaatccagtggggaattatttgtattctacttatatcagaaacaaaaggaaataaatttaatatttctggttagaaaaatgtgtgaaaatgatgggcttcatactttattatctttgttagtattttcattttcaaacacaggatactgcagaaattgtttacagtgtaatgggtgtgaaggttatttgtgaggtggatttgcttttttagcttgtattgtaaaaaaatttccttaaagagcaagattgttttcttcctgctgcatgacaatggtataatgaatattatttcaaaatgcatactgtgttatattatagtacagtgcattatagatgaagagaacaacacagtatgaatagtaatttatcataagaaataacaagtagctcaaaggattctttacctttaaattatactgcattttatagtaaaataatgttatcaaatgaggttgagtacaaggcaatgttttgtcagttcctcatttactcaacccagggtttctcaacattggcactagtgacattttagattgtgcagttccttgttctggaggaatgttctatggactgtacgatatttagcagcatctctctcctctacctattagacaccagtagcatctaaccaccacccccaacccagctgtgacaatcaaaaacgtctagaaacattaaaaaaaatccactggggagaggagagcaaaatccaccccagctgtaaaacactgatctaaccaaataatattcatacaaaattattcatattaaaggcatcatataaaaatcttactctgcactgtttcagctgcttttttagaatttctgaatccccaagggcaggccattcctccttcagaaaaacatcaacttcagccatccatttcttcagggtttgtatgtgattctgaaacgagacccgttataaggcattactggtgtgctgattacttttaacacaattcatcattgtgttatgtctaaacacaggcccaaaaacaattcccatgtttaaaggatgtctctaagtagttcttgaggcaaagaatatttttactaagactgcatttttatggtctactgtatgagcactggtgtgtgaagtctgctattgttaaaaatacaaaattactaccaaatgtggttttatgatgttactctcgagaacattaaatcatatccccctctagagaaattttaagttacaaaacaactcatgagaatactaaaaatgtgtccttacagtacataaaacaaactatgaacaataaactcaatgtaatggtgtctttatagcctccctaaacccgaactttcacaaattattttctacagatgacagtttaaatagtccttccagttgggaacttttggactaatattttgtcatcttcaaagacagagcttttgcttttatttgtctgaccagtacgaagtaatgatcaggtaaaaatcatcatcttttatcatttataaatagccagtatctctcacccatgattctttcccgtattacctttttttctgctgttttgccacttctaaaaagtatgattcaactatgctgtctacatgtgttattttcttctgttttacttaaatttacattgaaaatatgtgctccacagaaagtttcccctttaatgtgattattaataataatttttaaactatttatctaagagaacttcaagacgatcaccttgctgttatctttcaagtctacatttgttcttatttcacatcttcactgtccttgttcaggtctttttttttttgtttgttttttgtttttttttttttttttttttgagatggagtcttgctctgtcgcccaggctggagtgaagtggcacaatcttggctcactgcagcctccacctcccaggttcacgccattctcctgcctcagcctcccaagtagctgggattacaggcgtgcactaccatgcccagctaatttttgtgtttttagtagagacagggtttcgccatgttggccagcatggtcttgatctcttgacctcgtgatctacctgcctcagctgcccagagtgctgggattataggcatgagccactacgcctgggctgttcaggtctcattagtgactccattaatgcactggctcgttttgatatctgcctcggtctcacctcattctaattactgatctacagtgatgccagtaatctcctctcctccttcctctcatcttgggaatgttttgaaaacacaagtggaatcatattatttccctctttaaccaatagcagttttttcttattaagtttttattgttattattatcagtcccatcaccactagattaaaactcagattgtaaaacatagcatccaaggacattcactgtctactctcaatccagttttccaaccataatattttattaatccccatatatattgtctacccagtgttgaacttatatcatttaactgaaaatgctgctatgctttctcaagaactctttctttctcggtattagctaactaaattctacctatttaatctatagcagagacaacctatgttccgataatatttcataatcctttttcctagtttatgttggatttccttcctgcctactgtgacaacctttcccatactgtttaatttatttaccatgcaaggctgaataatgctacccccaagatgtcctcaccctaatctctgaaacctgtgagtatattaccagaaaggactttgcagatgtgattacattaaggattctgagatggggagattatactggatcatccaccagggcataatgtaatcacaaaggtcctaattaaaaggaagtcaacacagggaacaggatagggaaaggaaggtgagaaggagaggtagaaagagagggagagggagatagacagggagagagaaattgacactagatgatgttacactgctgactttgaagatggaggatggggacatgagacaaggaatgcttctagaagctaaaaatgccaataaaacagactctgtcgcaaagcctccaaaacagacaaagtcctgctgacaccttaattttagcccactgagactaatcctgaacttttgacttccagaactctaataaatttgtgttgcttgaagttattaaatttccggcaatttgttaggagtgccataggaaatgaatacacctaccttcctccttcactagaatgtgggctccttgataacaagagccatgtaattgtgccctcttaggccactggtcttgacaaataatagatattttcatgcagtatttacataggtatgcatgtacacatatgtttataagtaaagaaatgctatgcattaaaaaatgttttaggtttgcttagtgctttggtttgtaaaaggtaagcacaaaaactaagcagctagactgggatttaaatccaggagcatattgttgcaatgtttttccatcataccataacgttttcgacatttccttcccagcattaacatttgtcacaataattgaccactcaagggacacattacttaccttattgaatattttaggcttttagaccttaatgcaattgttggtttactgtttttctttagcttgagtggttattagtatggtggcactattcaaacaaattaagtcaagggaatttggtttcaggaagaaggtgatgtggtaaaatttaagcatataattacaaattcgatatggtgataaaataagttattactatatattacatatgtaacattaatatacatatacaacaggttacatatgtgatatatattacattagatatgtatatatgtacatgatatataattccattatacacgtatatatatatatatatacacacatatatacatgttatatgtatgtgtgtgtatatatatacatatatatatggaagctaaaaatgccaataacacacattctctttcaaagtctccaaaacagacacagttctgctaacaccttaattttagcccacagagattaattctgaacttctgacctccagaacagtaatgtaataaatttgtgttgtttgaagccattaaatttctgctaatttcttaggagtatcataggacattaatacacctacatttctactgcacatatacatatatggagttatacataatgggatgaatatataatgcaattttatgaacatatcaccatattttatatataatagcacatatagacagcatagttgactcctactttttataagtagcaaaacagcagaaatgaaaggtaatataggaaataatcatatacatactatacattatatatataaaatgattacaatatacctctgtataatgtatatatacataacttttttctagtcataagctaaatgattacccgtatcttaaaagacaaccagactaaatggatgattggttttgaaaattattaaactaaaaacatgtttaattcctattggtaatggtgaaaatagaaaattcattctaaaaacactgagaaaactcctattcttttcctagaaggaataagcaaatcgccatcctttgtaaaagactcatgtcttttcatcttctcactaactttgaaagatgctgaaggtcaaatgcttatgtacctttacagtttacagtgtatcgttagggaaaaaacaagtaaataaaaatgagggtagaaagtaaaatcttgaattacctgaatttttcggagtttattcatttgctcctctagcttttgacaatgctcaaccagctgggaggagagcttcttccagcgtccctcaatttcttcaaattctgattgatatttccggctaatttcagagggcgctttcttcgacatctctttcacagtggtgctgagatagtataggccactttgttgctcttgcagagaactttgtaaagcctaaaaaacaattttttaaatacatttaccctaattgatgaataataattgatgagttttagtgaaattaactgtacttgaaatctatatgattcaaacatgtaaacaaagtagatgatcttctatcagttataaacttctagtggtaatttaaattttacatattatcctaagagtaacttgaatattatttagtggtatttaacactccatatgtatttttctgaacaatgtcaaatatatctcaaaactatatcttacagagccaaaaagttttggtgcatctaattttactgaattaagtatatatattaataactgcatttgtgatacagttaatggagttgaaattaattatactgagctttcaggaaagtaaactctacataaaactatagctaataatattgatatatggaatagaaaaacttattgaacaatctatgtacttaatatattttcaaaaaatgttattctgttatgtagtattatggtgggattcaaggatagttttgtggagaatttataaaatttatttatacttattctgtataacacatgtaatttcttacagtaggatcataactttagacttcccctgttcaatatttactttaatgttacttttactttataaaataataaaggctcatgacaaaaatggaaaaaaaaaccagaactactagtactttatataaattttcaatttgttctatgtatagctaaatattaaatatatgatcatgtatgcacatataaacagttattctttcccctataatgtgacctatatcaacccaaaatttgtcaaatatctaagttttatagtttcatagtatcctatgcctatttggtggtacttaatttgtttttttactttacttttttaagtttatttcactttttcaaattgttcccctatgactgattatttagacaatatctagcatataactacactttgagctaggtgttttagtgtgagcatttgcccatgtcaaataattattttttcaaaaacaaaaattgtaatggcttttctagttcaacaatttccattattagttctacacattcatttctagttttccactcctgtaaattatgtttatctctatctacctacctatctaatccatccatccatccctcaatcaatcaatatcctatctatctccagttccatttacatctttgagtgtattctgattatttccatcagatacagatttcatggaaattatattaatgttgtatgttattaggatgcactgaagagttaacctcagtaaaattcatattgaatttacatttccagcagtaagagacaatttttatttcaccacttgcaaattggtacttatatcttttgtgtgtatgcaatttagtatgcaaaaaaaattctcatcttgtaatttttttacttcttcctttacaatttaagttacaattattcataggtttattattcatatatgtctctttttggaggataccttactcaagactttcttccttactcacagaaaaaaaaagattccttggtatcatatttctttaaaattgtctctggtgtttttacaatgtttgtgattgtttccatcgatttttatgcttctccacctaaatttttataacattattattttaaatattttccaaaatttgggcttccccacattttttgaacattttattgtatgtggtttttattttggtgtaactttgggggaaatgttcatatctttttttttagttagttaatacatttcccaataatatttatgaacaattattttctttcctatctttttcagtggaaatagtctcttctgctcatctaactgccttttcttgtgttttctccactcttattcttgcacatttttattcttatgtttaaaagtttactagttctattaggcaacacatttttccagatagactttggaatcattatgccaagcattaaaaaccacaacaaaaggaaacaaaaaaggtgaaacagctaccatttggtattgtagtagaataaatatctaaataggacaatacataatgaaagttgtttaaatgtatttttctttgaatacattacttcaaaaaaatatttaattatccaaaaaaaattctatgtgataaagtttaaatttgaatttttaaacatttttcttaaaatgcacatattatctcagcttctaaatataactaatacgttttcatgtcttcagaaataaaaagttattgaacatataatgtagtattttataataagtaggaaaagggctgggcgcagtggctcacacctgtaatcccagcactttgggaggctgaggcaggcagatcatctgaggtcaggagtttgagaccagcatggccaagatggtgaaaccccatctttactttaaaaatacaaaaattagccaggcgtgatggcacgcactataatcccagctactcaggaggctaaggcaggagaatcacttgaacccgggaggcgtaggttgcagtgagccgagatagcactgctgcactccagcctgggcaacaagaatgaaactccgtctaaaaataaaataaagtaggaaaagtattataaaatctcttacaaattatttctttcatttcccatattagtatatctttcctgatagaaggatgttaaaaaaatgtagctattagaattcaaatgtctcattacattacagaaaattaatgtttaaatttaaaccaattttataaatatagccagccctccatatttgtggattctgaatgagtggattcagtcaactactaatagataatatttgacaaaaataactacatctgtactaaacatgtaagactttttcattgtcactacttcctaaataatacagtataacacatattttcataatatttacattgtattaggcattataagtaatccagagatgagttaaagtatatgggagcatgttcataagttatatgcaaatattacaccattcatataaaggacttgaacatctgtgaattctgatattcataggagttcctggaaccacttccccatggatacgaagggatgactgtacactgattttacccaccagtttgagaatgtgacaggagttacaaataaagaagcaaaggtggggaataaaacaatggtttttctaataatcaaaatcaatacatctgaaaatgcatgctaaattaaaaatatacttcataaatagatcatacaattgttttcaaaaacagcatgtatatatgcccatacatatatatccatagatagagtatatgcataaataatactgtaaagtctcattttcatttgctcaatgggcaaactaccatacttgtcagaatgacttaaattctaatattatttaaaggttatatcaatgtgaatgcttgataagcgtgctttattgttttgacattcaaatattcacagacctgcaattccccgagtctctgctccatgatttcatagtcggtgacactaagttgaggtatggagagtttggtttctgactgctggacccatgtcctgatggcactcatggtctcctgatagcgcattggtggcaaagtgtcaaaaactttatcaaaagggaaaaaagaatgagaatcacttaattgtttcacactttgccatgttttcctaaattgtcagcaaactcaattatattactagtttcaaatattaacaaaattagaaaatctgaaaaatatatttaatatgattatgaagatacattcctgctacatgtgtaatatgccagggaccttacacatattacattaaattcacaaatcagcctgtaaaatctatattgttcaattcgttttataaggtcaggaaacagaaaaacagataagggcaggaaacagaaaaacagagaagctaagtaaattgcccaaggtgatacagatggtatttgcagaaaccgagcagggtccaattgtatctgatactgaaaggctactctctctcagtgttatcatttgccttggaaaaaaaatagtatcattatccgaagaccttgatttttaaattatatcatgtcatgtctaattttactgaaagaacacccatgtacgcatgcttagtatatgtatcaagaactctagtaataaccccataaatattatcattcttaattcttataataaacctgtgagacatatacattgttaatcccaattgcaattgagaaaacaggctattaaagaggcatatgtgtatgtatatacttttatatgtataattatattagggaaagtattatatagagatatacagtatgtatatacaaacaagtttatacgttttaaagtatgtatgtgtatatgtatatatatgaaatgtgacttaagcagccacatggactatattgaaagagattagacacaagattgagaacgctgcagagaactgtaaaccataaaaaggacataacatattttagggataatccaaaagaaattctagaattaaaaatacagtaagtgaaaaataagaattaagtgcatgggtttaacagcaaatttgacaggggtaaatagaaaattactaaatcttaagattcagaaggaaatacctggaatgaagcatggagacacaaaaagatagagaacacagtaaaacggtctaatatatatgcatcccagaatgtggcagaagccatatttaaacagataatggctaataatgtttctaaatacatgaaatcacactgcaaagtcctggtttatatcaccacatcaaataacattatctaaatcatattattttaattgctgggatatgaatgtcatttcaatataccaattccttctacactaaatgagaagaatataggaaagtattttgcatgtatttaatgtagtattcagatggttgcgataatcttagagagtgtgttggcaatggatgctgaaatgttagaaatggataatttttttcaatatgtttatattgcatttatttgggaactcataaaaatgttaagagattatatttaatctgagcacttctgatttcttattaaaagatatttgtagtacttaaaatctgttttaatttacataaataatatgtttctctattaacctgatgcatttattttttatttttccataagttattgggggtaaaggtggtatttggttacatgagtaagttctttagtggtgatttgtgagattttggtgcacccatcacctaagcagtatacactgtaccctatttgtagtcttttctctctccccccaaccttccccacaagttcccaaagtccattatatcattctaatgcctgtgtgtcctcatagattatctcccacatatcagtgagaacatacaatgtttggttttccattcctgagttacttcacttagaataatagtctccaatctcattcaggtcactgcaaatgctgttaattcattcatttttatgactgagtagtattccatcatatatacatacatacatacacacacacacacacacacacacacactcaccacagtttctttaaccactcattcagtgatgggcatttggattggttccacgattgtgctggtgtgaactgtgctgctataaacatgcatgtgcaagtatcttttttgaataatgactttttttcctctgggtagatacccagtaatgggattgctggatcgagtggtagttctacttttagttaaggaatctccacactcttttccatagtggctgtacttgtttaaatccccatcagcagtgtagaagtgttacctgatcaccacatccacgcaaacatgtactttttaaaatttttttgattatggtcattcttgcaagagtaaggtggtatcacatggtggttttgatttgcatttccctgatcattcataatgttagcattttttcataagtttgttgaccatttgtatatctccttttgagaactgtctattcatgtccttagcccactttttgatgggattgtatttttcttactgatttgagtttgttgtagattctggatattagtcctttgtcagatgtatagattgtgaagattttatcccactccatgggttgcctgtttgctgtgctgattgttccttttgctgtgcaaaagctttttaatttaaattaggtaccagctatttatctttgtttttattacatttgcttttgggttcctggtcatgaaatccttgcctaagccaatgtctagaaagttttttccaatgttatcttctagaatttttatagtttcaggtcttaggtttaagtctttaaaccatctttagttggtttttgtataatgtgagagatgaggagccaatttcagtctcccacatgtggctagccaattatcccagcaccatttgatgaaaagggtgtcctttctttactgtatgtttttgtttgctttgttgaagatcagtttgtgtaagtattttggtttatttctgggttctctattctgttctgttggtctatgtgcctatatttataccagtaccatgctgttttggtgactatggccttatagtatagtttgaaatcaggtagtgtgatgcctccagatttgttctttttgcttagtcttgctttggctgtgcaggctcctttttggttccatattaattttagaattttttttctaattctgtgaagaatgatgctgttattttgatggggattgcactgaatttgtagattgcctttggcagtatggtcattttcacaatactgattgtacccatccacgactatgggatgtgttttcatttgtttgtgtcatctatgatttctttcagcagtgtttggtagttttccttggagaggtctttcgactccttggttaggtatattcctaagttttttgttgttgttgttgttattttattttattttttgcagctattgtaaaaggggttgagttcttaatttgattctctgcttggtcgttgttggtatacagaagagctactgatttttgtacattaatcttgtatctggaaatgttgctgaattattttatcagttctagaaactttctggaggaatccttagggttttgaaggtaaatgatcatatagtcggcaaacactgacagtttgacttcctctttaccgatttggatgccctttatttctttctcttgtctgactgctctggctaggacttctagtactatgctgaagaggagtggcaagagtggcatatgcatttatttgaattctagatgattattaataaacaaaatccaaaagggaccttataaatagcagtgaagtaaagaggtatttagttacaatgaagcaaatgattgtgtctgagatgtcatttcagcaaatgatctagaaggagaggggactatgggcagacacatggcggtatgttggatgaatcataagcttcataaaatttggtttaattgaacttgaacatgtctcctctttaacttctttctggtctttctgtttaatgaaaactgaaacacttcagtctctgaattattgatctttttctgtataacttctgatctgtccaacaactgaatctcacaggaatcacttcatattggtaaactataattaaaacatgcatattttaattcctccttgcattccaaccctcatcctagttttgtattaaattcatttgaaactggtcatttcaaaaaatctaatctcttggaaattcttttgtagctttaagaaataaacttccaaagattggtttgggaacttgtccatctaatatagtttgtgaggcaagctggaaaaaaaaatacacacctactaacataaatatcacaatttctttttctgattttcttatgtggaatgtaatgacactatgtaatgacagcagtaattgctatcaaggttcaggaaatgcttgacaaatttgcaacggtatagagtatctcatttaaaccatgcaggccagggaatgccagtgaagaattctaaatctgtttcagataagaagaaagaaaaagtcttatacagaagctaatgtacccaagggcaaacacagtatgagctgccccacctactagctggtgagatatctgtagatgctgcccttgtgatcccaacataggagcagaaatagaccagctccatctacggaaactcactttttttccttttatgtagaaatagagattaataatccaacagataagtttatctttactgacagcaataagacaataaacatatccaatctaataacctaccatcttaaaagacctcgagagttctactgacatcattagactcagcacagactcaggaaaaatatggcctgaagatttaacgtttagccaatatattgcttataaatatgtaacttttttctctaaagaaagtattcctatgacagtttctactattcggctgctaaaggaccactttaaaaatgcagatatctttttggttttattagtgaaatatattcaacaaaatgaaaatcaatataagtgattgcaagcttggaagcacgtgctgtaaattattgggaaaataaaaattaagggctcctatcctgcactactgtttatcttgaaaagtaaaaaaaaaaattccattaatatctagacatttaatatagccatgtgagggatggaagtgataaagtataggcaaactgacatctaaaattatagtaaaggaatacaaaaaagaagttttctgcaccttttgtttaaaaactgcttgtctttaactcttaaaagagggaggggctaaagggaaaagaagagagaaaaaaggagagcaaaggacagaccaagagaggcaaagcaagattcttttgtgataacaaaagagctaagtatgaaattagatgctacattttctaatacacatgagtctatgtcaagggcaaaccactttaactggaaagcaaagtaaacagagaagtatattgaaaattctgagagacataactatcgagataaagagataccagagcaatcggttatatataacactttactgaaaaaaaaaatctctcctcttgaaaaatagaactactcagaaaataggcacttaagcatcagagaatgtacaatagagagaaggaagacgtaactgtgccaaccaataaggtagcaactggctacccgtccgttaagcacttgaaacgtggccagtttgagttgagatgttttgtatatataaagacacaccagatattggacagttcatacaaaaagaatgtaaagctatttccacattttaaaattttaattctaagatgaaacaatattttcaaatgacttttacctgttgatctgttaatgtggtttctagaacatttaaaattaaatatatggctcacattatttttctgttggatagtgcttagatagaagctggaaaaggcacccatgtaatccatttagggggagaaagagatgatatgttagtagtcttaatattgacagcatttaaaaacattagaagtcctgttgtgaatatgaaatcgagtccaatttgaattccccattattacctgtggggaaaaaaatgcactgcacatgtgtgaagaagctgaactaatgacatatacctacttcggcaaaatgctcaacttgagcctttaattccatgccaaccagatcccacctttttcctcattccccatgatcaatctaaagtcaaggagataatgcaatcagcaaaggctccaaactttattaaataacatagaccatgacaaaagtaagcatttctctaaaatgtgaacactgacaaaggtgtcaagaaatacaacaggacccatgcatgatatatgatgattaacatactaggaatggtccttcagataattacaagtgcaaggaagtctgagtataacttgaatttctaatgtcaatatataagttgtttccttagtttgaaatacaaggatctttgtgattgggaattcaatcaacattttagcccaatttcctatcaaaatcaatattctatcctccagtcaaaatatgccttttaattacttcacgcctttttgcttatgcaacttgctctgctgaaagtcgctgctgctcaggctccattctcacaaagggcacttggtgtggtctgacatgagtgaaatagatgggtttataggaattttatctaagatcaccatagaatttgttttataagtcataaaactccaatgaaccaactgaaattggggtcattttcataaatactgctctattattcacctcctggacaactgatttattttccaggtaagtctcatttttctgaccaactttgtgtaagtataaactaccacactacagaaatatttattagaatttaagagtttttttcttttgctgaattttccctttttctaaaagcagctctatccacttagcaatcctattttcaaaatatcatgttaaactatttcatatttaactaacaaataataattatgtgtatttatggggtatcatgtgatgttttgatctatgtatgcattgtaaaatattcactcaggttaattaacatattaatcacctcaccaacttatctttttttgtgatgcggatattaaaatctattcttttaccaattttgaaacatagatttttattaactgtgtccaccacgcagtactagagatcgctacaatttattcctccagtctaactgaaactttctatcatttgatcaacaccttccctttcccaaccttcctcttccccccagtctctggtaactacctttctattttctgtttctataatttgacttttttttggatttctcatataagtgagatcatacagtatttgtctttctttgcctggctcatttcagctagcctaatgtccgccagttctatctacatggtggcaaatgacagaaattccttccttttaaagactgtatagtattccattgcatatatatatcatatatagacactggaatatatttatcactatatatatatgtcactatatatatcagtatatatatctctatatatcagtatatataaatcactatatatatctaccactatgcatatatcactatatatatcacattttctttatccattcgtcctgtaatagacatttaggttgtttccgtatcttggctgttatgaataatgctcaaatggatatggcatgggcaacaaaagcaaaaatagacaaattagattgcatcaaactaaaaagctcctgcacaggaaaggaaactattaacagagtgaagaggcagctcacagatcaagagaaaatatttgcaaaccaaatatctggtaaggagttaatatccaaaatatatagaaacctcaaaaaactcaacagcaagaaaacaaataacctgatttaaaaatgggcaagggatatgaacagacatttctcgcaataagaggcaccaatggccaacagatatgtgaaaaaatgctcaacatctctaaacatcagaaaaatgtgaaaaccacaatgatgtgtcaccttacacatgttaaaattagaacggctactttcaaaatgatgaaagataaatgttggagaggctgtggagaaaagtacacttacacattgttggtgggaatgtaaattagtacagccattttggaaaatagtatgaggttcctgtcacataaattttataaatgtgtgtgtgtgtgtgtgtgtgtgtgtatatgtctacatgtgtatatacacagtatgtgtctatgtgtgtacatacacagtatgtgtctacgtgtgtacatacacagtatgtgtctacgtgtttatatacacagaatgtgtctacgtgtgtatatacacagtatgtgtctacgtgtgtatatacacaatatttgcctacgtgagtatttacacagtatgtgtctgtgtgtgtacatacacagtatgtgtatatatgtacatacgtatatgcacacacaacttgtgtacatatacgtatatgtacacacagcgtgtgtatatatatatgtatagctttaacttggcatttagcgagttttcccatgattcttgaggtcagggaacaattcttttatctcacaataagcacatagcttgcttaaataaacatgtctgctatgcttgctcttgatggtattgataaaaataacacaatttttaaaaggaacatttacaaacagtttacctagtttctggagtgaaggagcaatgcaacagattatgtgtctactggaacaaaacattcctttgcctagatgtattaaaaataaaattttaaaataaaaaatttaaaattttaataaagtaaattaggtcaatttcctgaactgcagctagaagagttacctcacatcaaactttgttttaattcccagtctcagcatcctaacagggaggggtagagactaaccatagagcttgaaattgtggccatggagagcatccttgctggctacccttaaaattttcttctactgtctctgtaagaggtaaaagttattttctttcaattctggcaagaatatcttctgtgctacacctccccagatcatcacctcttcaagggttgaaatgatttttctttatcttatcacaactgtagtttaaggttcaatggactctcctctgtgtggctattctttccacaagtcttcctgcttctcctcagacttgtattgcatttcttcttcacataccagctagagggtgagttttgaaaaaatacaactaagggtacttaatttcctcaattgaaattctttcggaaatgtctactgctcttaaaatccaaacctgttatagaagttctataagagcaattctaccctcatcttgtcctaatctttcattgatttgttacattccagcctttctggcctcccttatgtcttctggacatgccaagccctcattcttcacctttggcaatttgtgtttcttttcatttctcctaatgtcctttctccaacttatcatatagctggcacctgcacattctccaggtttggttctaacatcatctccccagaatcacggtttcagacgccaaagtaattataatctgcaataatattcagatattcaattttattatctttctttcaataagctccatgaagacatattgctcttgattttctccaccatgtatattacctagtgcccagcacttttacggcatataccaggtgttcaaaaatatttcttgaatttattagtgaaaaagtgagcaagactctgttctgaaagcaatctaatggtgtagaacagaagagaatcattttgaaactttagaacagtcaaaacactggctttgtcataactaataatgtcactttctccatttttgcaaaactaaaccaaaccaataaaatccctaataattattttaacatgatttccaaattgttaatgaaataaactcaaattatatgaccaatctttttccttctttacattaagaaataaggtttcatttttttctttgttgaaacaattatctacaacagactagatgctgtgtttctatattcatctagcatataacatgagtttactggttttcagtctctagaaaagtattttatcaactgtcatgggaaacaattccaccccctcatcctcccagacctaggcaaccactaatcttatttctgcctgtacagatttgcctattgtggccattttatatcaagagactcatataacatatgatcttttgtgactggcttctttcactcagcataatgtcttcaagggtactccatgctgtagcatgtatcagtactttctccctttttattgctcagtaacactgccttgtatggatgtgcccattttcttcatatagtcatcactggatggacatgtgggtttcttctacgttttggctattatgaataatgttgttatggacattcgtgtatacgatctagttcttacagcatcccatatccatgcttttagttattcaaaccccattagcttacttgtgatatagttgtaataacaaatactcaatgtgtttctctctgagggttaggtaaaatgatgtataaattagttatgcatagagtaaaaagtgctttgaaaatagaattttatctttttatattattttcttctatcacttatgtcaggtaacaactaccaattccttatgccattttccaacactgatagtatattttaaaagccaggtttttgtgtgaaaaagcaagtttaaaaaagtaaagaggaaataaaagtcagtatggatgcctaggcacttctgttagctcttatttcctgcatacttaatacgtccaaagtactgtggaggaatacaagaaatgagatttactccctggtgccagttcggatataatgcatacacatgtgcaattatttgaattaatttcaaattaacaaaatcaactgctatgtaatttcatatgctacatttttcattccatatatatatatatatatacaccatatttaattaaagggttatttattaatctagacaagcattccaaaagggtgaatagtaaaattaaagatgtgtagctacagtggaagtggggacaatttgtttacatataatagcagtgaaaaagttaggaagttttataaacaatcatcgtttgtaggtatgaaatttaaaaaagagaagaaagatgatagggatggatggatggatggagagctgtatgaatagagactatatattattacgtatttatattgtaacatcatagacaaatctcagttatcaaacattgctattctgaacatctttaaagtaaatgataaaaagttgaactttaatatgattaagaggtatatacagattaaagtaaatttccagtgaaatggctcctttgcacaacaattgctgcatagccactaaatgtatttaactttaagggggagttatgtatgtaatgacaagtgaaaatacattattgttaaatatgtcaatatttgaaaatctaggacatttaaaatattttcccaaattgattttgcagaggcacagtaacaagtatactgaaatccactagagggagctgatactatttataaagttttactacctgtacaggaaaataaaccccttagcaaaaacgactctgaagtacaaaaaaaaaaaaaaaaaaaaaaagtatttatcctttgctttatttagctcatttcatttttgtaaaaaatgaaaagctgggaaatgagaaaagcgttgtgtatcactacattaattctggaaatgatattatatggtgaattctttaaatatttacaaagaaaagcaataggataatatattttccaactaatttaagttttagtagtaaacaaacacatgttcctgtgcttctcatgacaaatttgggacagagattttttcagaaaaatacttttatcttaatgccttcaaacccgattttactcaataattccttttgtgtgcacatgaacacatatatgcatgtatatagtgaatcaaaaccccatttactatttcttaaaggtggtcattcatctgtctctgaaaagaatttttgtcttaaaactaagttgatgagtagagatattttggagcagatactatgtattaacatcatcttattaaagcaattcaggaagagacaaaagaaacatcttgaaaaatttgctagtcgcatggcatgaatttgcataattgctccacttttatcttttatcatcaaaggaaaaaataggatttatgtaattatagtgatccagtagtaaaatgtagcccaaagaataatttgtcctttgctgagtttcagttgccacatgtatgctaaagctataatactcttcagataaattgacagaaatattagaagatgcctagcaaatatccttgtatatacagcgagccagacttaattgaagtgtattcatatgacctcaactgctcttttattttcttctatattcaaaacatctgattttgaaatctacaatcccccaaggagaagctattcccatacaaaacatgttttgtttctcaaagtcacaaaattattatgaggacaaaaaaatctacagacagcttatctgttacaccagtatttcgttccttgttaatacaggttgtagggagaatggttccatttacagaaattattgtttcatgttagtaccttctggatttccccacaaataaccattttggaaaatgtcaagttagccattttaggctttttacttacttgtctgtagctctttctctctggcctgcacatcagaaaagacttgcttaaaatgatttgtaaaggccacaaagtctgcatccaggaacatgggtccttgtcctttctctttcagggctatgctttgaatttttaatcgttcaatttgaggttgaagatctgatagccggttgacttcatcctgtgccatagagtatggaaagtaagtaacacgtttactttgcatacattacattttgcaaaagaaggtattaaaaagcagtaaggcaagtttagcttaatacccttcacaaatatctgataagaaacatccatgacagtatagacaagcctctatcaccagccatacatttaaggataccttggctctttgttcaatatgtatcatcctatataatgatatttaaatttcaagatgacataatttagagcattaatgggtatgaatgcgtacagtggaaaaatactatgcatgaccttaaatcctttccataaatcaaatataggtgtttggctgcacccctcttatatcaaaatgatgtgcgcttgcttcaaattttaagctcactcaatgaacaatattttctctttcatttctgcaaaatataaattacatatatacctacatatatgtatatgtgtatactataattataaatatattttgatacaattatatagattatatacacacatataaaatctatataatacttatacatatgtatgtacacacccaaatataaaaatatatctataatcttctatgttttgtatggtctcattacttctcctgaccaaacaggcaaccactgcttttttttttttttttttttttttttgggacagagtctcgctcttgttgcccaggctggagtgcaatgacgcgatcttggccaaatgcaaccttcacattccaggttcaagcgattcttctgcctcagcctcctgagtagctgggattacaggtgcccgctaccgtgtccagcaaattttttttatttttagtagagatggagtttcactgttggccaggctggtctcaaactgctgacctcatgatccacccaccttggcctcccaaagtgctgggattacaggtgtgagccaccgcgcccagccaattgccactttttaaattacggtggctgtccaggtttcctcttgttgtcctggcataattattagtagcaccctgtttcactctcagtagtaccctggtttgtatgataaaatcacatgaacactgctgtactgtcactagctcatgtggcaactgggcacctgaaatgtggctggtccaaatttagatgcatgaaattaccaaaatatgtttaattctgaagattaagaaaagctaagaacataatctcaaagtttttaaatactgattacactttcaaataatatttttgatgaatcaggttaaataaaatgtactattgaaattcaattaccgtttctttttcctttcctaatatagtttctagaccattttaaattacatatgtggcttgaatttgtggctagcactgtatttcttttggacaatgactttcttcacagaattggaaaaaactactttaaagttcatatggaaccaaaaaagagcccgcatcgccaagtcaatcctaagccaacaggacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggattccctatttaataaatggtgctgggaaaactggctagccatatgtagaaagctgaaactggatcccttccttacaacttatacaaaaatcaattcaagatggattaaagatttaaacgttagacctaaaaccataaaaaccctagaagaaaacctaggcaataccattcagggcataggcatgggcaaggacttcatgtccaaaacaccaaaagcaatggcaacaaaagacaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaacgaactcaaaaaaatttacaagaaaaaaacaaacaaccccatcaaaaagtgggcgaagggcatgctattctctacataaatgttttcatgttcttgtttccagtgaagttggaattgtttcgtatttaatacatatataatttgaactcaaagttttcactgccctttttaaaagtgttattatcatggctgcttacttacaattcatatatatgctgtctttagaaaaaaatacttgagggttagttactatttaatatgtaacaacaggaaaattgaaatttaaaaattggaacatgagcccattagaagaaagagaaaatggaaagaattataccaattctgaacgaattgaaatctgagcttcctgaaaatcaaagtgaaaaggcaaaaaaaaagttaatatttatggaggcattcatactctttgggagagagtaacttttgtattaggagaggctgagaaatttatcacataaattctgtcatggttgcaagactaatgtacaatgccacttattctcattaaaaaaacataaatacagctttcagaggaatgtgtttatgtggttataatggtatgagctgattcaggtaaaataatctctgacgattcaatcgttttggtgggtgaagattaaagacgtttagcaaaatggaaggtgacctatatttctctttcaaatataaatcctctcaaaccagtgctagaaagttggtatatatccatggataagaaataagacaagaggtaaagggtaatattctgtatttatagtacagaaatatatacaaataatttgtatgctagatttacaaatggcagcattggcatctactgtgaaccattaagaacctgatttatatttggccagatggagggctgccatttttcccgttcagggggctatagaaagagccaacattatagccaagtgtgctctgaaaaacaaaggggactttgaaactaataaaacatttgggcaaatgttcagttgagaccttaatgttctgagaataaatcatagaagagatacttttcaactgaagtattctgtgtttaaaaagatgtgaacaattagccattatttccataaaaggatttggtttagttggtcctccagagtatggtatctcctttgagtctgtttattctttaaaattatatgcttatctcatggaagcttttgtatttttcacaggaaagggttcatgaattttttccaattctgataaggctctctaacccccacaatattaaaaaccagttctgccgatcattagaatatgagctaaatatgcgctctaatgttataaaacttctccaaataaaataaaacgctgagaaacatgttataatttatttacctatcactaatctcagcagaacagtatatatatttgcccttgtatgaataatattaagcttatcttgctaaatattttacctaaagtgattcttcaaattaatagacaccaatgggtctgagagaaagagtaaggggtgataaggaggtgacaacggaatttggatgcagtaagagaagtattttcccttaggatgacttcctcaacctccagacaatatttaatatataaaacctctggtgatctccatttgttcctcaaatcaagaccaagatactagcaggtcccagaagtcattggtttgtctcctatatacctgactgattcctgtttgtctctcctctcattcatctgcccctctatgttcagcatttacaatggtcttcattcaggtgcttggcctttattgctccctcttgccatgttccttctgcctggaatcttgcttaactgttctcttacctaattctaacttatcacaaaagtctcaactcaaatgttcctccctcaaggaagatgcccttggtggctgtatcaggttcgtttttccctgttactcattctcccaaagctttgcatcttagtttaaaccactgttcctagcaggaaatttaaaaatattgattccattgtttcatatctctcttctctgctttccgtaaatacaataaaagcagagtccatgaatgcccactctaatattcccaaaacttagtgctatgggctgaattgtgtcttccaaaattcacatgttgaagtcctaaccattggtgagactatttggtgataggacttttaagaggtaatgatgtttatatgacgtcatcagggttgggtaagggtggcggggtggggggctaatcccttagggattggtggctttataaaaggaggcagagataaagagagagagaaagaaaaatagccctcattctctctctctgcatgtatacacacagaggaaagccatgtgaggacagagtgagaagttggttatctgcaagccaggaagacagccttcaccagaagatgaagctgaaccctaccaaaccttgatcctggactttctctcacttctagaactctcagaaaataaacctgtgttgtttaagccaccgagtctgtggtatttattgtggcagactcagctgattaatacactcagtagcattcttaaacacattagagacacttaatgtatatattttatgcatgaatgtactgtgtaggtactattactaactactatatctgaatctcaagaatcggataaggtaacatcagatttttgtggcaagaaataatgtatttggattattcctctgattcacaggaaaagcggcattggttctattcttaaattacaaaatgcatctcaatgtagaaattccttagatgtgtgtatttgcctaacaagtcaagtgccttatccaaggtattctttatccaaaagtatactttctgagtttatttcctcagcaaactaacacaagaacagaaaacctaataatgctacaggtccgatatttgaagaaccattaagtccttcaattgtttttctcttcaaaatagctttgaatttctcatcactttttgggtccaataccttttctaaatcaaccttgtcacctttccatgtctattctacctttatttaagccattcttttttacagtatgcaaatgaatctccactccttgccttttgtattaaatgtaatcatctcgatctatcactaaacgttcatcctggaaacgttttagtccatcctctaatcagtttctcattccccgcgaaaagcacatagctcatagtaacaatgaaaacagtttaggctattttcattattatacagctcttgttttcttacacttgaaggcataatcctttcatctctttctcaggcccttttgtccacttacatcttgtttgcccctccagatccactgtccgctcttctcctgttacccaggagactgatatttacagatgacggttccttgtcctttgtcttacgattaagtttagtcagtgaggagccctgacaagattctggaggcagggaaaaaagtgaagtggggtgtttatttgtctgactccatttctatgaggattccttaagccggccatgctgcttttaccatgaggatctgactgtctccttctgagtttctataactgctctctcactgatcctttctggactaaaaggggtaagaactctgatgctgggttactacactatccggtgtggttcctctgtactccagctacattttaaaaatatctttttgtaaagaaaccttcctcaaattatcgtaatttgagaggtccatcagttttaaatattttccttatgtatctagttatactgcatccaagcttgttgttgacccgtgtttctaactatttccatggattccactttttcaaaatgactatgtttcactcgtcacaaagaaagagttccaaagtgagaggccattttttacaggatacatgtggtttccacactcctaaactgcctcatgcttacgcaaaccgacacaatcaattagcgctgtgtaactacgccaaatacaattttagaatccgggtatctacgtcttacatatttaaacagatttctgttgcttacattttgaactttattgcgcttagctaaatccttagaaggtgaacgtttcattactaaataatttgttactgtcttcttggaaattgccaagaaatacctattgattatgctccaaatggaaggagaagagattcttaccttacaaatttttaactgacttttaattgctgttggctctgatggggtggtgggttggattttcaaccagttttcagcagtagttgtcatctgctccaattgttgtagctgattatagaaagcgatgatgttgttctgatactccagccagttaagtctctcacttagcaactggcagaattcgatccaccggctgttcagttgttctgaggcttgtttgatgctatctgcattaacaccctctagaaagaaaaaaataattaaatatatcccctgaacccacagactgaaagaaatgatctgaaagccaacacatcctaattataaaagtattcaccacatgaatgatttcaaaccagatcaattattttctaagatataaatgtgtaaatatgatttcagattattcaatgtgaattatcagacttgcgtcacaacaatgaatatcaatgccatcaagtaataagacataagatgtagaaaattagaatatatgtaaataaaatattaaataaaaacttaaataaaaacaaaagtgctcaaagctctgatgggagctggaaggctgcatgaacaagtaacattttggatgttttcagatacattttacatatcatacatattactcaaatatacttccccaaactaacttacatttttaattttaaaaatgggcttggaaattagtttaaatagtattttcatagttttaaaaagaggaaaaaaaatccaagattattctttatttcatttacagaagattagaaataaacagattgtcggctgggcacggtggctcatgcctataattccaacactttgggaggccgaggtgggggatcacggcatcgggagatcaagaccatcctggctaacacggtgaaaccccgtctctactaaaaatacaaaaaattagccgggcgtggtggcgggcgcctggggttccagctactcgggaggctgaggcaggagaatggcgtgaacccgggaggcggagcttgcagtgagcggagatcgcgccactgcactccagcctgggtgacagagcgagactctgtctcatattgtccatggatgcgaggaagaaaaacaagtactaggaaaaataatctttctaatgtgaaacatttttaaatttataaatgtagaagttgatctcaaagttttaaaatcatctgtagtaataccaaacccagaaaactttatcaagggaaaaatggaaacacaagcatatcattatcaccattaccattctggagtacctactatgtaccatggaatatgctatgtcatttcatatatgacgaacgccagtccaagtacatattattccatacatagcatgaaagcatggcaacatcacgctgtgctatgggttaaaatattcaaactctctaaagttagtttacaaaatttagactttcttagatttattagcttatatagttttcttaatgacagaatataaaagagaaaatatattacatatgatatcatgcatttttaaacatagctacattagcactgataactttcttatactttggaaatactgaatatttaaatgttttatgttccctcatgtacctacagagatctcaaaagaacataaactcactgtaaggttctttctctaggttaaaatacctaaaagttcgaagagtagtttggtagaagagtaggttgcctaagataatctacttttataaatgttcattttacttaattttctggtaatataatttagttaaagggaagctaagttcttaaaaagtctgaagaacgtctctagaaacataaggcctgtggttttgctaacttgcacatgcctcccactttatcctttttaaagactaaaaaaaatatagatgtgaattcaacaactatattattttatcctctttcacttccctctgccctgatagtctaatgttctatttgtcataatgatattaatgctgccaaaccatgtccctcaattcatttgaaacacaactgtaacttcactaatttcaaagcataatgctactcaggatggcggtgaaggagacaaactttgcaaatattatcgtcaactattttcccctccttcttccctgatatatttttaatgagatacaatggaaataatagaatgtaaaaagaatatatacatggctccatatatctaagtataaaagaagtccgtggcctacaggagctacatattctaatatcctcctaatgcttaaggaagcaattgtgacatgctgtttttgatcgttagattttgaggagtgatcaaaaattgtaccaaaatatttgttaagcgatgcgattaagtaactgttgttataaaatgaccacatttggtataaagtgtaagagaagaatatgaaacttcaatcgtatgagcactccgtttgaaaaaagtattatgataaaacgttaacatttctggaaaataaaaagataattagaaaatatactggacagaatttttaaattatgttaataacaaaaaatgtggcatggatctaaatgatcagatatttaggagaaatattttcagcatatgttgaacttgaacaagcagttagaagtccatgaagggtgaaacgtcaacatgaaccaggtattaaacaggcaaaaaagaaatgctaaattaaagggaccgatagactgatgctggattgagtcttattcaacatttgtctaaatgagacgggaacacagagagaaatcactttgtgtccctgagaaaggtcaaccatacaaatcgtagcaaatgaaaaaatgaaactataagttgattttcaatatggatatgttaattttgttaaatgataaaactacagtgaagtaccaataggctctgcagtatccgttaaaatctagggacaggttttaatgagtcattgttgatcattacacaaaactctatgttttgccccccaaaaaatgttgcaatatatcactgtaaaagaaatttaaatggtgaagaaaagtcagctttgtacaaattcataacactgaaatttataatacgctctatttatttgcatattgatctttataactgaatgcaggcaatgaaaatgcagtgataggtaaaagaacgacatctataatagcaaaaagggggaggcaggcagaaaggcagagaaatgaccggtgagaattctggcgttaaagagaccggagttcaaatttgatgccccttactagatgtgtgaaatgggttcagttacttaatttcactggatcttgtttttctcatccatgaaatgaggattaaaaatagaatcgacctcataggatacttaccaaagttctgagttaacatatataacttacttataacaaatgctgacacatactaggcaacaaagacatattagacaatgccatatagaggaaatgaaaaagaatattcagaaaacaagggaccagctctcttgtgtgaaaattagggggagaggaagtcttcttaatgactgaaacaggacatgtataaaaagttaataatactattttaaaattagtcctaattttatataatatatgactaatatgggatatagaaggtgtatttatacattttttaaagaagttttatcaataaccagggatcctttgagaccaggagttcgaggctgcactgagctatgattgcatcactgtattctagcctgggcaacagagcaagagcctgtcaccaactaaaataaaaataaaaagagtttatttgggaatcctggaatattctgccacatttataatcatgtgagattgaagttataaagaaacgaaaacatttcaaaaaaaacgtggaaatttctagatgttactagaaaagacataatgttgggcacagaaaatcagaagtcttgctatgaaggatttgtatgcaaacattgtattaattcattgtgaatatgctgcctgctcaacaagggcataaactgtccttctaaactataaactcctataggaaatgtctccactggcagtatctaatagaattctcagcttggagtagaaagagtataactacactgtactcatgaactcattcaataccaaatcaatagtgtactctatatgaatataaaaattatgagaccaatgtacactgaagccaaaagccatacacaaacaagcacacaatctctcttgtatcaaatttgctttaaaatacttgggcaggggatggagaggatggtcacgttacttactgacactgtcacgttaataaccgacactgtcacattacttaatgtacctctcttcaattaaaatgagaaatgctattacttcaactttatgaattaattgaccatctaaatgccagaactactgttgattttctaagaaagtccattaaaacctttctagaatgaaaaagggttcaaagcgttatccaagtaaatatttgcatatggattttattattatatataattgttttatatgtattccatagaattatgctccttgactcaatggaaaattttaacttttctaagagtttgtaagtgtaaatatctgaaaagttttaagtatcaatcatctgagcatctgttttctaattttgtgttagctatttaagaatacaaatactaacacaccaggcattatgagcaatacttatggaaaccattttgttgtagcacattagaatctcagggataatggatcataatccattcacatctcatattctaaacaacccctgaaatagtctgtgaataaatatattgcacccagaggaaatggatcattacttgaagtgtatccattaattttattacttgtgtacagtgcataacagactgttagaataatgttaaatgtgcaccaccttccatgcaagtacttcagaactgccacttaaagtgaagtattcctcatcaagtatattcatcattagccatgaagccagggtagaataacacaaaacaagtgtttccagagctcttgaattaaaagaatatttggaatagaaacttaaaataaagctgctaataaacagtctcctatttttgctgaactttaagtgagggttattacaagtccatttagcattcaatgtaatagtctaaaatgtaatatagagatattcaaaacctgtgaagacaagttctgaggctaaattttagaggtttctgtgaccacactgacttaaagtaatagcttttaaaaattaatagtatatataaaagtaatacccctagtgagggcaatataaattttactaatatagcccttttgcgtttttattttcaaacatcataaaattaaaaaaagtcagatttttactcatatttgttttggccactcatttcccacaacaacagtgacaacaacagtctctttctttcacacacatggacacacacacgcacatgtctgcgcatgcgagttcacccgtgcatgcacgccgtgctcacacacacccacagaggctcttccttttggagattagacttaaacgaagaaaaatgtgcctgtcaattaaaaacatttattgaatgtgaactctgtgtagagcattatactaagtgtcatgtggagaaagaagaaatataaatcaaactgcccagtactgaggaaggaataagagaagaggaaatatatgcaactgtggaaggctactcattcatgatgaaggggctgggctactacaagtggtacagtctccatgccacatttgtatacagactatttgcaatatgtcttgccattaaaatatatgattagaagacttgctgctactgaaagtttttccagtgatcatgagagttttagctttgagatgagccagactgaccataatccctaccctcacccatctgacaaaatctggttgcccacctcaaataacataattcatgtgaaattatctaatgagctatgaaccaaaatacaagaaaaaaagatagttacttggttaatgttatggataagaagagctctcgtcagtgttatcattctgtgccatttaattacaacagttagcatacttattatcaggtatcaccttaaacactataatctagcactcagggaatgatagttttgagatgttctttagtctaatatactaataattactacttttatttaaacatgtccttgatgtgactgtccttagactcttaattaacacacagaaaactacaaatagaaattgaaaatgaatcacaatttaactaaccctattacataattatagtatctcctctagaaattatggtgaaaggatcttagagactaaagaacgagaacctgagctacgcctacatatgttttcaaataaatgttttgatatggtcatcttttggtaatttcagtattaatatggaaaaccagtttatctaaactaggcttttttgtgttatgcctgattgatgagactgtatgtactcatgcgagaacactgttttacaaaaaggattacgtctaatcctaaatagataaaaacagacatatgtttaggtataatcatatgtatattattttagccctaggttgtcctaaaactccacaatctcaataatacactgaaaggccttggtcatgaaaggcatcagtttaaagactgttcaaattaaaatcttagaaaaccattattagttagcaatattattaaagcattagaaagattacttactatatttaatggctaaatttttctaaatttctaaattatttataacattttgtatttaaattaagaaatgtaaaaataaaccttaaagttatatcacatctttcttaaaaagtaaaataaagaatttggaaactcccttttcaatatgcacagctacatgaatatataaatacatcactagatacctggtctagcctctcacttgccctcattaagttaacagtttcctgagaccagggttatgatccaaagcttacatattgacggtaagctgcatgaaaattacagctatccaaaaatgtctctagtaaaaagaggtactttgcaccatccaatattctgtcacatttatccaaccaattaatgctgacataagaacagtaaattaattttaatgttagttcaaacaaaaaatacagctaagatagagataaatcagttaaaaattataccaaaatttcatgccaaaatgccagaaacgtgatttttttttttagttaacactctccttttagtagcttctctttttagtctatgatcgtgaaagatcacttctactctgaccaaaagaactggaacatccataaggaaaacgtccatgtatagttttaaagcaggcaaggaatttggccaactcatttctttggttaaaaattccaaataaattagtaagaatctcttacggtcaataaactcttaatatacaaattattgctgtaaaattaatgatatggttaatattaactgttttaaaattctgcatacaactcttcacatttgataaaatacagtgaaaataaaaagtatcttccaattgatcataaaacttgtatgtgacactgaaaaactgtacatatgttactagacatactgtttctagaacgtacaactgatttttaacaatactttgcaccatcaaatgaggttcccttctacattgtaaccatggtaaattttgtactttcaacaaccttaacaccctatcctgtcttctcagcatatgtcttaaattccttcaacaaattgccttcaggacaaacagattttgttttctgcattacttaagtgatgttgaatcttcaatgcttcatagacatttagaaacggacagaaatcatttggaaatatgtctgatgtaccatttcaggtcaaaactgaagtaaaatttaagttatgagaaattattttttccatcttggaatttcattctaaaagcaaactgatgaattacaaaattattctaaatttttaaaaagtagtttaatcttagggcaaattattttaagtagaaaattcagtttgctatgcatataccagtatagatacatataaaatatagttcacagaattttttaaaatctataatagctatacttatgctattctacatatttttacactatgaatatatgttaaatattttcactgtggtaagcacacatcaaatttataaatatatacgcacatatttttattagtggcataataatatgagtggtttatacaagagtggttcatctttatcttaacttctgaggaaactatacgtggttaagaggaacagccatttacatgaggtcctaaatgaagcacactgattcagctctcattttcctttctatacaaaaagggcaagaatgtatgtgtcttacgtggttgtgagatttattatatctccatagcctaagcttgggaaggaagattctggacttataaatttaagagctttaatgcaataattgctggactcctagtttacagaaagcttcatttgtctttcagcttcatgagctacaccactcaactgtacttttgggctctatactaaaggagctattatgatttagggtagcagtccctctgaaatacacctgaaggggtacttcaggcacttaatatgtgtctagcttatctcacaatttgcacaatcacagaaaataaatattatgcaatttgttccttgaacgacaaaaacggaacaaatagataagttagaatatttgagcctttaagtaatttcataaattattttatttaatggggaaacagagctatggtcattttaagtagtcatcctagttatggcccaaacttgagcctaatgacgtatcagttcgaccatatctttactggtagaacaaaagggtagcataaaatttgattaacacagtcaaccaaacaggaatgtctcaaatcacacccctaccccccagtgttccctggtatctgccaaagttagcattttccttcagatggattattattttcacaccaaaattaccaacgttattacctcaacgactgccttaattttgcttttctaaacagaatctggtcaattaatatttactaagcacctactatgtgtcctgacttttctacatgcctccaaaaattagaactatgagggaaataatcaagaaaattaatattctcactagtcacacgatcatttaaatcctgcatgtagttttacttaccaaaaattaaaaatcattcccgtaatttctaaatgtttaaattatttctgattaattcagtgtaggtaagcttgatatataactatgacatgagaccatttaaagtatagctcttgcatcagcttattaaaatgaaaaagtgataatacagtttctagggggaacttacataacaactaggagaatatttttagatcacataattttatttaacatgaatatgctgttaagttgatcagttaaaattaccaagcaacatacatctaaataaaaatctactggtattttcattacctgttcttaaacttgttcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctacttgccctttcaagccttaagatgtttcactctgtcagcttatcacgtgaatctaaagactttttctcaacacttttgccatcaaaaacatcaaaatggcaataaaagcatgagccattttcatgacttgctacaacttttaattataagatttctactcagcttttttttacattatagtttctgatacatttcaacgcaagactgcaaaaagtaaaaaggcaattcataacaatgaaagataaagtgtcacataactaaaatgaaatttatcttttaaagatacaccattgaaattactaataagtatataggcggtattaaaaatcaaattgagaatccagtatgtatataagatggaaaaaataaactaccataaataatttagcagaaatatataatatatgtacatatatatttaaataccaggctgtaggctaatttttctttcaaaaataatcaaagtactcctatttccaaggaagacaagattgagtttcaaaaaactttctgaattcctttatttcccttaagagttacattttgaaccacaaatgcaaaattatttcagttaacaatagccagaatttcatactattgagtttagctaataatattcctatggagacataaattttaaactatgacagagtagaactacattactataatcatcaagaagtgttgactataacaatgtgtatgtcctaaaacataactattcaaataactataacgcaattaaaatatagtaagaacaacacacctgtgacttaacaatcatattataacaaagatttctcttgaatttgaggcagaaggttattctacatgagactattttttaagacttcatttacatccacaggcatttaaaaaaatatttccaggtaaaatactggagtacagatgggagggcaaataacagatacatggacagtctgcaccactgttgagtataaatttgtgcagggatggaaatgatctgtatctgtgtcatccaatatgatagccaataaccacatgtgggtattcagcacttgaaaggtggtcagcatgacttgaaaataaaagaatatttaatttaatctaattttatttattttaaataatttaaaatttaaaggttacatgtgaccagtgttaactgtgattgtacagcgcagatctaatacattcctttaaaagcaaatagttaagagataggcctgtaatccgagctactcagaaggcctgggcaggaagactgcttcagtccagggatttgagatcagcctaggcaaaatcgagagacctccatctctaaacaaacaattttaaaaaattagtcaggcgtggtgacaggagcctgtagtcccagctactcaggaatctgaggcagaaggactgcttgagcacagtagtctgagtaggctgcaacgaactatcattgcgccactgtactccagcctgggcgacagagggaaactctttcatataatatggcaatatcagaaatagttgcagagaaaaagtaatcatctagacaacactatttactaagcacattaaattatgtaaatgcttatacaataatccacatatttttatgtatctgaaaagactatctaatttaaagaaatagctacaaatgtaaagctttttgtttttgtttctctttgagacagagtctcactctgtcgcccaggctggagtgcagtggcatgatctcagctcactgcaacctctgcctcccgggttcaagcaactctcctgcttcagcctcccgagtagccgggattacaggcgtgcaccaccacgcccagctaatttttgtatttttagtagagacagggtttcaccatgttggccaggctggtctcaaactcctgacctcatcatccgcccagctcagtgctggggtggggcggggggattacaggtgtgagccaccgtgcctggcctgaataaaggttttcttaaaaatttattttaaagagtttcctaagtgggagacctgacgatatctgacttcaaggcttgatataaaactgcagtaatcaagacagagtaatattggcaaaagaacagacaggtaaatcaatggaacagaatagaaagctcagaaacagatccacataaatataatcaattgatttttggcaaaggaaccaaggcaatacagtggagaaaaagtctttaaacaaatggtcctgaacaacacaacatctacatgcaaaaaagtttatctaggcataaaccttacacccttcttttgttttaattacaattatttaattccaatttatttactttcatgttattcactggatcaacttcattggaagtttatacttttgatggtgaaatatctgacattattgtgaattttatcacaaattcactttaaaatttcaacattgaatatatctgtacaaatgataacatgggctgggtgcagtggctcacacctgtaatcccagcactttggggggccaacgcgggtggatcacctgaggtcgggagttcgagaccagcctggccaacatggtgaaaccctgtctctactaaaaatacaaacataattatctgggcatggtggcaggcacctataatcccagctactctggaggctgaggcaggaaaatcccttgaacccgggaggcagaggttgcagtgagccgagatcacaccattgcactccagcctgggtgacagagtaagactctgtctcaaaaataaataaataaaataaaataacatgaacatatatttttgtggaacacagcattatggttgaaaaccatgttttcttggatacacatggatataaagatgggaacaagaaacactgcggactactagagtggggagggagtgaggggaaaaggtccaaaatagtagctattggatactatgctcagcaccaaacctcagtgtcacacaatatacacacgtaacaaacctgcacatttactcttgaatccaaaagttgaaattataaaaaataaaataaaaatgaaaaataaacataccaaaaataaatacatttccactgaatttagaaatttgtgtaactgcttgaaagtaattgtggtgttcatataattcataaagttaattaataatgaatcaatcacagactctagagtaaaatgtaaaactataaaactcctagcagatagcagtggagaaaacagaggtgactttgagtttgttgatagttttttagatacaccaccaaagggatgatccatgaaagaaagaattaataagttgaatagtactaagttaaaaggttctgctctgtgaaagatgctgccaaaagaacgaaaagaaaagccacaggctcaaagaaaatatttacgaaagacatatctggtagagaattcttatccgaaatacacaaagaactcttaaaactcagtaacaaaaacaaacaaactaaaacatgggcaaaaatccttaacagacacctcaccaaaggaagtatacagatggcaaataagcaaatgaaaatatgtttcacatcatatgttaccagggaattacaaattaaacaatgagataccactacacacctattagaatggccaaaatccaagaacactgacaaaaccaaaagccgacagagaaatggggcaatgggaactctcattcatttctggtggcaatgcaaaatggcacagccactttggaagacagtttggaggtttcttacaaaagtaaacattctactatatgatccagcaatcatgcacttaggcatttacacaaaggagtcatatgtccactcaaattcctgcacatgaatgctgcagcagctttgtttgtatttgccaagacttggaaacaatcaagatgttcttcagtagatgaatggataaataaactgtgagacatccagacaatggaatattattcagtgcttaaaaatgagctatcaagccataaaaagacatggaagaacttaaatgcatgttactaagttaaagaagataatctgaaaaggctatatattttaccgcaggatttcaccctagattccaattccgaatatatgatagtctggaaaaggtaaaactatgtaaactacaaaacaatcagtggtttctagagattaggagagaagtgtagatgaacgggaaaagtattgaggatttttatggcagtgaaattacaccgcataacactctaaagataaatacatgtcattgtaaatttgtttaaactcacagaatgtgtggcaccaatagggaaagctaatgtataaactatgaactttgggagataatgatgtgtcaatgtaagttcatctgttgaaacaaatataccactctagtgggaaatgttgacagtggggcaggctatgtatctgtgggagccgggttatatgggaaatttttgtaccttctgttcaattgtgctgtgaacctataattactctaaaaatggagtctattaaaatcacaaaaaaaggtttcatgaattaggaatactggattcaatatcaagagtacaaaatgctaaaaaaaaaaaaaaaagccaatcattcacagaataaactccatcaggaatagctgtaatatataaaatactaattaaaactgagaataaattaagagtaaaatttaaaaaaaatctataaggtagtaattttgttttattttcttaaatacctatctcttagctgaaagatacacattttacatggtgctctgaagggcaacaaatgaaaactcagttttgtctaattagttaagaaactctgaaagtgacagacactttttaatatcttacattccacttgaaaatttcaaagcacccagtttgtggtattttgtgattttatgttcccaggatccctttccaattagcaggtaaaacttctgagttgtcttgaaattcagtttcacaaagacagtattgaattgtttccaggaacgtgcacaatcatggatggttctaatttgttggttgaactgaaaagtccatgaaaatagagtagctacaacatctagttaaaagtaagatcctagatgaagctccaatatttctattttctcaacttattagtttttgtgatctaagttatctgtccttagcagcttatggcatacttgtttttcactacttacatttattctccattaaaaggtaaatgttatatggaaagcaccctgagcatcttagaggagaaaaaataagcacatttaagtaaatatgtaatgtaaatatcaagaaagacaggaggatttggggtgtccagaatttgaactttatccagaaaacaatatacagatgaaagaaaaaatatataccacaatacaacacataaaggaacaatgacaacaagctgagtaaagtgatgttctttgagttacttttagagttatcttctcctatcagaggggtttctattttatctacattgagcttttgctttagtttttgtgaaatgatataaaaagtagaatgagaacactatgtggtctttataaatattgaaaataaattatcaatagccctctaaatgttatcatcataatctctttattctaagcttactagaatcaattaatattactaacagagaacaaaacttatatttgaatatctcaggaatcatatttgacctttaatatcttgttaaccacattgttccagttattctaatataaatagtctcagtaacaaccaccacaactacaacaaaaacaataatctataaagtaggtactattactttcccattttgacagaggagggaagtgaggcacagagaggtttgtgaaaattttgaaaacaatgcaatagccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccattaactcacagaaatatacattaaaaagcacagaaaagcacaaaaaccaaaaacaaagtctaaagagatatattttgctgaaaaaggaagataactgtcctcattttaagtgactgtgtatcaacaaagaggaacataggccttccacaggtctatcttgcaaagtaaaaactggttcaaaacaaaaacaaaaactggctctcacatctattctcttactcagtcccatcaaaactgctcttatcagtctcaccattggcccccaagctactgcattcaatgactgatgttcagttctcactttacctatcaccatgatttgattgagaggattcctttttcttcttagaagtatttgctaatttggcttcacgtactacttgaacacagttttcctccaacttcagaggtcacctttcctccatctcctttgcaggttcctaatcatgtccctgagctcgcactttggagtgtcctaggcctcaatctgtgttttcctttgtttaggccaaaaacagaatcctccactcccctctctctctcaagcctcacattcaatccatcacaaagtcctgttggctctaacctcaaaacatagccagaaagtgagttatcatggtgctcactactaccacattagacaaagtaccccatcatctctgaggggtatgaatgtttcaaaataggatactaaaggtctttatatttcaccctttgttctctgattatatattatcaacacagcagacagagacaacaggattcagctcaactcgctgacagctgaataaaagctcaagtccttaccatggtctgatcttaattaacttccttaacctttctgaattcttctgctgctaaacatcgtgatttttctgctgcagccacacgcttaccttttccctgatgctacaggcatgctgctgttacacggctgtgcatttatttttccccatgcctaaaaaggccctaaattacttacttggacattttcccccatcaaatgccactttttcagctaggccttttagtgccactctgtctacaagcacatgcataccctctcattttattctgctccttggaacttatcactaacattccacatgctttacatattagtcttgcttcatttccatctttcccactagaatgtaaactatataaggtcaggtatccttatctatatccttctctactctatcccaagtctccatgaaagtggctggtacattataggtacataataaggcgagctctattttagcgtaacgcgtccatatacaatattatggtctctccccttacccacaatgctctcttaaagtgcaaattcataacgaactctaatagctttatataaagtggccataaaaccagtacatggggacaggtgctgcaagctcagtaaaggaaggatggattaaatcaaagtattctagaaactgcatattagttagggagttgggcacatccatcttttcttcagctcaagtcctgatactggtaataaaccaatacctaagtagaaaagaaagagtaccatatacaatccatgagtcaaaacttggtagaatcttacctctctgtttttatttcatggctctgatcttccacctcctctctctatgtgtgtgtatgtacatatatgtacatacacatacatactgtatatatacccctttcccatgttttcaagaccaagggtatcatctgaatactcttcaaccacagtcttcattttcttttatatatttcatcttcaatgaaatttggactaatattaccatattagtccaaattccagtatttcaatattactccaaatacctacagtcagacttcagccttcactactgtacaaaaagttattttgtgaaagtcattaatttggccgggcgcaggggctcacgcctgtaatcccagcactttgggaggccaaggcaggtggatcacaaggtcaggagatggagaccatcctggccaacagttgaaaccccgtctctactaaaaatacaaaaaattagctggacgtggtggcacgtgcctgtagtcccagctactcgggaggctgaggcaggagaatcgcttgaacccgggagacagaagttgcagtgagccaagattgcgccactgcactccagcctgggtgacagagcgaggctccgtctcgggaaaaaaaaaaaaaaaaaaaaaaagaaaagaaagtcattaattttcttcttgttaggaaaaatgcttcttacaacattcagtactgataaaaactacaattacctcctcgaaattgccatgttcataaaaatacctctgcccttgacaatattatctttctcttaaatttcgtcctcatgaagtcatccagcttttctgtatgtgtgtttttctatagagctgtttatcatatatgtgtctacatgcatatacatttttaatcttgaaaggatctatatttcataacatacagtttttaaattatgctattaacatatagaatactaaatactttactcaatatatgcttaatatatgatcacatgtttagaagccactactcggattctaaattatttagtacacataatttcaagtaaagtatacagaagctaaaaaaggcatcagtaaatcaatgtatcagaaatgagtgattattgtgggctcatgaaaattcttagagatcatgaagaattataaatactaaaatgggtaacctaaatgcaaaataaaaggcaactaagttatataatattcaataaaaggaagaaaagtaaaataatttgaagcaaagaatacaacacagggaagttcacaaattcctcaataagttgattaaaacctctttcagacctctgttcctccttctttattagcacctcttaaaagcctcctctttctgtatcttctctaacattatgaaaataagttatggatctctatcagtcctactccgacattagaagtaattaagaatctactcatttaacattctataatgaagttttaccctttgactgaagagtaacttattcactcaaatgtttattcagaagttgttctatccttcatattggtaatagatcctatcttaaatgcaactgcagaactgaaaaaaatcacatatccatatagttaaacatttattggtttgtgtgttaggcatggggacaccaaaaacaaaacacacacacataaaaccaaagccacttcacgttcaagtcctgatttctagaaaccaacaatggaattgaaatgaaaatggctagaaattagtttgtgcaagtaaacaaaaattagatcattgtaggctttaagagggcaatatgaagacatggactttgtcaacactcttcagacaaagaccactggaacatatttgtaggttatcaaagttaacctgatttacacgctgcaacgagagagacagcgcatcacagggaactatggggctgtctctaagagtatgttagaaaaagcttattttaagatgtgggcttgtgttacatgatagggggcatcaaggaagtggggctttgttttgattggatgttgtaaggaagtagggtaattctatgttgagtgtcctaaaatttttatctagatggcaggaggaatgcagagaggctaaagctgtgtttagtaaagaagcataatgtgtcacattaatgaagatgagggatatttggtcattaggcgtggtttggacaatgctattcttttttactgtattaagatatgattacaaagtggtcttgcttttatcttgattcatcacaaccatagcgtgtccctgtatgatgctggcatccctagcaattatttatattcaaccagagaacatcagactggctgcaagtaccaaggcaacatctagcagttccaaagcctaactgaagtgccaagccagctcctggctatcagtagctgattttatctttctcaaatgattataaacacagacataacaagatcatactgaggttttaatatgttcgctttggcagaggtgatgtggaaacttctaaaggaatataacattagtagcagggaagaccagctacaggattgtcatcttaaatagaagtaagccatgatattagctttaatcagggttttggtgatgggaatagagagaactggacattttcaagagctgttaagggagcaggattaattgaacctgtcaaagattggacttgtgaatggtagaagaaaaatctaggtgacccagttcactttcaggtttctggattaggctgtttgcagggtgaaaggaaggagaaagaataaaggaggtctggggaaataatgagatttaagatatcaggcaaacatcaattaaaattgtctattaggcagtcagatatatcaccctgggttttaagaaagagatgagctaaagatacatatgggagaagggttcatttgaaaatagacactatttgaatgggaatgaatgaggatatccagagaagaaacacaaggactctgaagaatatcaatattaaagaaaaactgaattggaacaaatggccaagaatgtgaaagaattaatcaggagaaagcagtatcccataagccaagcgaggaaagaatttcatgagggaaaagaggttaataggttctagttctacagagggattgagtaagataaggcacgttaagtattcacatgcatgtttataggagaggacacgttctaaaagatgaaaacacaaccggtttaaaagctaatgataaagacctgggatgtagatttttgacaatctggatatacagctgaatggaaccaggtggcttaatacatagtcagtgatgctgctgagaacacacacccagagatgagcctcaaccaggtgaaggatagcctcttccactaaggcaggtggaaaaaaaaaaaaaaaaaagatactatgagcacaaatacccacaatttgagaaatattatttcgactaaagtaggagatgaaatcatttactgtgaatgatggggaaagtttaggtaccccacaaaagcttgaaataattgttgagagaaactaagttgaaaatatacttaggatgcacggaaagcttatgaagaactgctggttttgttaaaatatgttgttagtgccgggcgcggtggctcacgcctgtaatcccagcactttgggaggccgaggcgggcggatcacgaggtcaggagatcgagaccatcctggctaacacggtgaaaccccgtctctactaaaaatacaaaaacttagccgggtgtggtggcgggcgcctgtagtcccagctactcaggaggctgaggcaggagaacggcgtgaacccgggaggcagagcttgcagtgagccgagatcgcgccactgcactcccgcctgggacagagcgagactccgtctcaaaaaaataatcttattaaagaaatggagtaatgcctgacaatgacaacatctacatacatacaatcatgacagcaggtagctgaattgaggagatgagagaaacaacagcttttagtgatagcaggagagcccacagggatgctgaaataactaagaatgaaagaacaaattggttgaaaaaatctactaacctagtgccaaagtcttcaatgagaaaatatgataaaatggtagataagagatggccagaagtcattaactgcaaggaaagaggtatttttacatgaagagagcagtatctttggaattgtctctgttaggtgagggagtcagtcattctaaagtagtgggggtacaaaagagggatgagtcatagtgctgttttcgagggtaaaattggtttccacgtatgagtagaataagtatatagaaggcttgtcttgaaaaagtgtttgagcctgccgagtgagagtgtgggaaagcagaggaagtgaagcaaggaaaagaaagtgcaatagagcagagagagaaagatagaagaaaatatagactcgaggtacctatactctgggtagtaaacacagataacagagataggagaaattggaagcattaactggcttgatgatttccagcgggagttggtaaaaagttgattctgaaagagggtaatcaagtgcagatccgaggaagagcccaaagccagatgaccataacgacttgatagggagggtttcaagagaacctcacagaagctccagattttcagacaccttatcaaatccccttgtgatcaaaggaggctattttttttgtttgtttcattaccaatttgcgttaccatgtgctcacggaaaaaattcgagttgttagaatctgttaattcagctaaaaagtctgaactgcagtgatactaaaagaatgtgagaggtaactgctacgtaaagcccaagattgtgtcctagaatattgattctcgagcctttatgtgcataggaatcactcctggaaaatgttcaaaggcaaattttgatttactagttctgagattctatatttctgacaagctcccagataatgtcaatattggtggtccagggacattttgattagaaaggtcccccagaagtcagcttttaaataagtgcattttgttaattatatgaataaaacacatggtgaatatacaaggaaaaaattatgcttaggtttaaaagttgcattttttaaaatatgtgaaattgaactgataatggcctatgatatgctaactggctaaaagcatttgaaaggagtaaatgaagaaatcaagtgaaaaaaaaaagagttggtaatatttagccatttttaatgaaagcctaaaaatggattaataccactcaagttcatgacacgagcctgccatgagtttaaaataacctatataaaccgacaggtgatgtagtaagaaaattaatggatacctaaactgaatatccatcatcgtaattatgtatttctctcaaggatttttaatacatatacattgtatttagcctgagggaaacatcaaggtaaatcatttcatgtcccattttagtaggcaattaagaatgatgttgttatttcagaaaatgagagttcaggttgataaaggggactcacaaggtatcagaaaaccagttataaaacactgtacatttttgagcacttttagtctgtcatgctcccgctattgataaaatgcaaatcgttcataggtaaccacatgataacaggaacttttaaaatttatattcctgaaatactgaaactcaattttcctgcctgatcaaagctgtcttaagataaagaaacagagtatcagacagaaacctgtgagaatcagatcaataatcatttttaattagctaataaaatgctaaaggtgattcatactttcagtggtcaaatatgtaacatgatgtttgaaaattagagtttaatgttctctaattaattttctactactaagagaatttccctcaaaaatcacagcaaacaatttaccttcaaagaagtatacttgaaaaaagacatttagctaattttctacaattatatattatctttcagttttcatatttcccatttcttgaaacaatttagaatagtctattataatgctgacaacagcatgtcttataaagctaataagtaatttaaaatagctttccaatttataagtagttaactctaagaagaactggtgacaaaattgtcttccctttttcaagcagcctaaaaaatagattttttttccagaatatatatatatcttttgttgatctccaaaagttccaaccccaacagcaaacattagcttgtaactgaggtaatgtcgtatttgtaaaaatacaatggattttgaacttcatgatttgaatcctggagagaaaaagcagagctaatatacacatttagatgtgatcttcccatggataaaattacttttcattcataatcactgcttccttagcttgcccattttatttactctgcctgttagaaattattttacaaactgttgccaatcatatacaaagatgcatgttttataattgttgaagttgaaaaattaaagccttgacaatttccctaaagatgaaacactttatattaaattaataaaacttcctatttgtgaaggtcaaaattataccatctcagaagggaataacaacaacaaagcatctgctaccacatgtaaatactgagaaaggctggacaccttttagataaggtaatacacaaatatctgggaaatttaaatatcttataatatatgacagggattgatgactataaagaataactttttgataacagtgagaatatagacatagtcctaagtatggtatctattatattattctattctattttactctattctactctacacaattgtgcaagcttgctaaggcctagccttgaggtaactgaacaatatatgaaaggaatcaacatgaattaatgtcataaaattgttaatttatagttaaataatatgtaagttaaggcaagtttatgaaaggcatccctagtcagtcacagaagaatccagaaagatttctctaggctaaactttgattttgcttgctatctaaaatatatttttaagacatattaaacagcattttatcatatcgcattaatctatcaactagtagaatcacagataacaaagcacggagtttacaagcagcacaaaatgagtacagatataaaaattaatgcataacctacattgactttttcttttaagtctgagaagttgccttccttccgaaagattgcaaattcaggactctgcaacacagcttctgagcgagtaatccagctgtgaagttcagttatatcaacatccaacctaagacagcaaaaaataaaagtcattatttcttgattatctctttcttctatattaaaaaaagcaatttatccacatttatcattcttttctcaatctgagactcctgcctgacacctctattagtattaatagcagcactattttccctgttaggtagactcaaatttggagtcagctttgatctagagtcttatgatcacagaggtcattttattcacctcaatgtaaaaatcacttctacaatatatcctgtaagctattacccagcctctgcttgaatgtttccactatttgaaaaagtactacttcccacgataaccttttctttttggaaagtatttatgagaaaaaaaaaattcctgttggtggtcaccattgaaacacatgcttttctgtagtctccaatcatactgcctctgggtttggccacgtgactttctatcacaaatgggacaatagtaagagtactgcaagtaaggttttgagaagtgcttgcatgtcagagcttgactttttagagcacacattctgagaagacaacaattatataagaagtacaatgaccttgaggtgatcatgttttaaggaaacttgatctgtccatgtgaagaggccacatgaagaagcatggggcaccaggcatgcaaataaagccctctgtgacccatctcaatgccagctgaagacagacaaatgagtgctccagttgatgccacatagagaaaagaaatacccaaagggcactgcctacgttgaagaattaggagaaataataaataggtgctgttttaagccactacattttggtgtgagttgttatgctgccataaatatcagatcacctatcctgttattttcaaacctttttttttttttttttttttttttttggaagagatctttggagccaccagggataaattattcattctaatctggtgatttaggtatagaagagccaaaatatggaatcaacccaagtgtctaatggaatagtattaagcctttaagactatgaatagcctttcatttgcaacaacatgtatgaacccggaggaaattatgttaagtgaaataagccaggtgtagaaagacaaataccacatgatctcacttacaagtggaatctaaaaaaaaaaaaaaaaaaaaatcaaactaaaagaaacagaagacaatgttcatttccaggagctggtgggggtggagagtagttggaaagatattggcaaaaggatacaaaattataaatatttgaaatccgctctttaaatttatcagtagatacctgatcatcagcctaccctatgcttaattacttcaacggatattctatggcttgttgttatcttagtttccttaaattgggtacttaaagggaacatatcagcagtgtgtaaaataaacagggaagaataattatctttctggtttataatactttcattgatatagcccatgatttcaataaatattttcacttcaatattagactttcaactcacattgcaattcaattgacttaaaacttctaggaattttttcacataaactatcattaaaccagttatatcacaacctaattactatcacaaacatatgacctgatctattgaactccagttttgggactttgaatcatataaaccagttagaatttctcacatttgttgcaggctattgtttaaaaattaaacagatacagaaattaatggaacacaaagcccttagaaaaacatattcgcattttatattctcacaaaattctttggttaggtatcaccaattccagctgcccataggatgagatggagcttcagagaaattaagttaattgacctcaataccatgggtcagaaacttgacggttcatagcatacagattgagttgttatttatcgaggctatccaacttgaaattaagagactagggatcctgattcctctaaatcccatgtcactgaatgtcagtaagttatctgtgtatgcattacaaatgtttatggatttttattgtgtcatatatgatttttatctttcctacattttttatccacaagtttgactatcaggttcctgtttcttcattcataatgttgattaaaatatacagtacaattatatgctgtaaaaatctttcacactctcttcagcgatgttaactccttaaatactctcctactatggttatttgattacctacccaaaccagtgaattatatttcaatcatcttttatgcatatttatcatcataatgtcttaaaacatttttatttttgctttggcccaacataaaatttcctgtgtctctctatctgcaagcatctatttgccagtatattggacagagaaggagtgctggaatgttaatactttaggggtgtcccttaaccagtgagagcttggaattggtgaatttcccagctcccttgcccctcagttggacaatcctgaagtatgatacacagtgtctcaaggggttccctgcatgattgagccccagttccttccagcagtaacctgatccctatatttgtgccatactttattggctgctttatttttcttatttcacttccctactttgtttcctgggatcactttccaaataaactgcttgcacctaaatccttctcttcagatctactcttggggcaacccaaactaaggcaataatcaacagcctcaaatgaacctagcatcctgccatacttttttttttttttttttttcccaagttgggctctaagtctctacaggaactattaaaaccttttatcaaagctctggcccatcctctttctgcagctctctcagatgatcttgttccctaccttacagaaacaagtgcaattatcagagtagaacttctttcacttcctatttccaaacaccatcagacccgcatatgtagccaccgttctcattcccttcttttacatttgagtttcccttcttttaattaaagtcattcccactacctacattttgaactttattctcttacttttgctcaagcatctgagtccatccaatttctagtatttgtttattttgagacggagtctcactctgtcaccaggctggagtgcagtggtgcaatctggtctcaccacaacctctgcctcccgggttcaaggaattcccctgcctcagcctcccaagtagctaggactacagttaacactgttgaccatactatccgtttgtaatttttcttcctttggcttcatgatgccactctattctaatttgccttctatttctatgaccattggtaattttttctttgcaggtccatcctcctccaccctatcattatgtactagatgtcaagacctagttcattaccaatcatcttctactctactatctctcaccagaaaacacatcagtcatcatgccttgaattgcaatctatttatcaatgattctgatatgtatatctctaattcaggcacttgttctgaattccacagctatataaccatctgcctattggatgtctccacttgcatgctgcaaaatctccttaaacattatatgccaaggtttaaagtttgatcttctccctcaaactagtactctatcagtattccccagatcagtaattagcatcaccatccctcatatttgttatcttcatctccgctatggactgaattttgtgccccacaaaagttcgtatgttgaagcctaattcccaatgtgatgatattaaaagatggggcatttgggaggtaattaggtcaagagggtagagccctcatgaaatgagtccccttaaaatgatctgaagagatcagtgttcttttccaccgtgtgagggcacagtgagagagcaccaagtatgaaccaggaagcctgcccttaaaagacactaaatctgctagttacttgatattaaacttcccaaactccagaaatgggagacataaatttctgtggtttataagctacccagtttatggtattttgttacagcaaaccaactaaaaccctctctcttccttcccatgtttaatgtattgcaaagtctaatctgtcacacatacattctctgtctcctgaatatgtatgcttcttcctgtctccatagccagaacccaaatctgtgttgccattaaatgtgaccaaaaataccgcaatagcttttcacttggcctctgggcagtatttatggaactctctcttttatgtactactggaaaaattatcatttctatcttttttaattgacgcataatagatgtacttagattgggggtacatgtgataatttaacatatccgtataatttgtaaagatcgcatcagtgtacttgggatatccataatcttaaatatttgtctatgctagatacattcaaattattctcttctagctactttgaaatatacggtagtaaaaacatatctgattatgttaccttcattcgtaaaaccactcaaagactttctcatttttcttagaataaagaacaaaatttcaacatgatcctttataatctggccttcatagacctcttaactgtatattctactttgtcttttattcaagtacttgtagaaacaaatttcgcttcatattttctaaagtaattcagagctattctttattcttgttcctcctccaatggaataaaatccttcactgactcttccataaatattttgaaaactgggttgttaatataatgcatttgggccactttggtgaaatttatttgtctgactcaattatacatcaaataccctctgactcataaatatgagataggaatatccaccagtcactttcaaattcacgctttaaacttaatctctctagtctcaccctcatttgatttagactatctctaagaaagattgctcacttctacttagaggtccctgaaactcaaacgtgcctcaaggtactaggctggcatgacagctgaaagaaatctgctgaagcctatgttggagaaagatttctactaggcgttgaattgacattgctcttgtttgcacactgtaggggctcagaaaacgataccccaaagtatggcactttggcatgctgaaactttgaactaaagaacactggaaggcctcaaaagcagcctcaaaaccaaggtccctctgaccttctcctcccctcctgtctttaactccacattcttccctgaagtgagtcatagtaaccagaattcttcttcttcaaggtaggtcatagaaaccaaaaaccctctcctccaaagccaaccataaaagccagaattataactctgtattttgcccacctttctctctattagctagccataaaaaattctctgacatacttttgtttgatagtagatcataagaccctcattcaagtggggtcctaccccatgtgtaggaggaaggaattctacacagacaggcctggctggttgtccctagtctattactatcagatcattccctttttgtccaatcacattcctacatggctgtctactctttatcaactctaagcataaaaacagttttcctttgggtcattgggtcttcatttttgaaggctcccatgtcacctaaaacttttattagataaatatctcatgcttttctcttgttaacctatcttttgttataggaatgtctgctatgacctgtataaggaggaaggaaagggatcacagcctttctgctcctataacatgcatgttgatgtaactgttataccaccacctccaattcactgcagaaaaaagaaacaaagttgtttgtttttagtttgaaagtaaataattttcattccaaaagaaatcttttttttttttttttttgagacggagtcttgctctgtcacccagcctggagtgcagtggcgcgatctcggctcactgcaagctccgcctcccaggttcacgccattctcctgcctcagcctcccgagtagctgggaccacaggcgcccgccaccacgcccggctaattttttttgtatttttagtagagatgtggtttcaccgtgttagccaggatggtctcgatctcctgacctctagatccgcccgcctcggcctcccaaagtgctgggattacaggcgtgagccaccgcgcccggccccagaagaaatcttgtaacacttttagaggtgtattttcctgaaaaaggcaaaattgtatgtttccttttaaaacggtcaaatgtctcctttttttccccttcataaagcatatactaagtgcttactatgtgccagacatgctattaactccataaagaacagagacgagaatgcattagtccacattatcaagtaatttggtttagtgaagcatttgtttgacaagataaaaatggtttagacacagaactggggctcagctcacactggtctttttaagaggataatcaaaaaacaccttctctgtaaattaggattaaatcagcttctagcctagaggctctgccaagtatattggttatctccacacaaagaaggctttgtggagtcaacaccatggtaactgtctgtttgcttctctgtctgtgaagattttaagggaggcctggacaccagttggcacgtagttctgataattcaaatcaattcaaacaacaggatgtgaaattctacagaaaggtctttcctcattcaattttttgtctgactttataaatttggaaaggggtcacatacagtgcgtgaacttcccttttatacaaagatcgtatggagagtgattacgctcgttttttgatgtacagatttttaaaaaggcaatttcaaattttactagggcagtggtgaggagagcgttttgtctaaggaaaataacctattcataagcacagaggttaatgttatacttcttttctaaaatggaacaaagaaacatattaatgagtttggactcttctcacctgttggagttcttccctttcatttctatcattattgtgatatcttgatttcatgggaaacaggtggacactgaacccaattcttacacaattcaagctctgagctattcctaacctaatcttaatatttattttatgttgcttccatttggacttcttccttcaaacatctctgatttccttgctaaaactctttttgtccacacataatgtgcagtcagcctacactctaatacttaacatgtaccaccatctcttagagttctgggagttaactgtcagctactagcattgttttctctccaatattctgccagtggatagcctcatctctttatgccagcaatgaggatggaagggtgaagaggaagcagaggcagggtttcaaggcctcccatgtactctccctgagtgccaatggcctacatccaacgcttagttttaggttcagtgacattttcaatgcacaatgaactcagtctccttcccggatcctactcagaccctggcttccaagaagcaattgcacgtttattttattccttatcaatttagcaactatcgcttcatcactttttgtggtttgtcgtgtagttttcatgtatttcactgctactagatattcctcagatatctttgctgagatgcatggcaaatgaacagacacctctgatttaaatgtcttcatgctttaaattgggtgctatctactcttcccagtgctttgcagatggcattttctatcatactttgcactaagtgagcctgggtatttaattacgaacgaaatatatcattcagatgcaactcagttaccttctttaaaaccctcaaggaaaacactgaagacttattttcaatgccatattcaacgttggattctgtacatgtatttttgcttcttcataaaattactcgtttctaataattcttttttccccactttaacaactcacataaaaccattgctaatgaacttatgtatcataagttgctcataatgtgtccctacacctttggaatcagtccactaatatattccttagtgcttaacttactttcctcatatacttaactctgtacttaacgtacttccgaatgttatcagactctatcccttaaatgcagtctaactttacctagcttaaaatctcctttagctaataaaaaaataacttctcattctctgttcacaaaatgattatttctataattattgatgaatattctgtcctctattcttcaagtatatcttaaaacctcaatttgttattatttatggttagcagtgaagcgacaatttttttctcctttacaaatatactcatcagaaacccctgaaattaaaacttgtaaagtcccatcatacagggcaagtaagtctttgatttttttttttcttggcaaaagtgtattactacaccaagacaatttttcaaaaagaccttccattttttggaagtttcaaaatatcaaaagcctggggcatatataccaaatattcagagagtgacaatttttctcagtattatattgtacaaacagactcagcctcatccagttgaatttcccataaaaatgatgtaaattaggttaattacatcccatatggtaaatactgagagatacctgtgtatataaatgtttaaaataaattcaaaggcaaaaacacatacaaacatctcaaagaactagagaaatgtttgccatttaagaagttgtcaattttgaattgtcaatagtaaaacattacatgaattagtgctatataactgtgctaattatgtcagaagagcctcctgatgggcactgtgttctgttaattttctttacagtgactgccacataacctattaaactaagatgacacatttacataaattttaattcagtcactttcaatatacaagttgcaactcatcattcccaaatgtgtaaactttgagagtggaagtcctccaagctcccagacttaactaatttgattagtgaactaggtttatgaatggccattttacatatttaaacatcttagcatgtagaatttcataaaaacttataagcctcatccttagaaacctgaaaggaaaatgctgatgcctgtgaaatacgttaaccattgcagggtcccagggctctaggcctagaccagataatttatgaaaccaattcttaatgaacattttaattagctaggaagcaagttttaacattaataggaacaaaactataattattctttgttggtattaaagaagaaataattttggaggtaagattttccaactttgctgtatttttaaaaatcacctttcttcttcagagttttccgaagtgagaagacattttaattccatattactatacaggcactttcctgaccctaaatccccaaccatttgaagatgacctactattcatcttccaaggctcagttcaagatgcacatcatctgtgaaggttttcttgatcaacctctctctactcttcccctttcaactttccttctgggaaaacttgtccctctctgcttgtttccacatggcatttgctttaaaaaaaaatcgagtaatagaatacaaattcaatttgcatcaaatagatcttataaaaatatcaaatgaaattcagtataaatcctattagttctaaaaatatttttaggactttgagatgcattgactacatggcaattattatatttttggaattacagaatattattaaaggggaaatcctatttaaccaaaagaaaacaagctaatatttagataaatagttccctctccaaatcaagatagtttgtatacacacacacaacacatacacgtttgtatagtgtaagtgtgtctccctctgtggaaggggggaagatagggccacatgattgtcttgtattttgtaatatgtgtgatacgtgtgtgtttgtgtgtatgtttaagttgctttaaatgtaaagtaaatgtgcatttaaaaatatactgagctgagggccaggcgtggcggctcatgcctgtaattccagcactttgagaggccgaggcgggcagttcacttgaggtcaggagttcaggaccaacctggccaccatgacgaaaccccgtctctactaaaaatacaaaaattagccagctgtggtggtgggcacctgtaatcccagctactcgggaggctgaggcaggagaattgcttgaaccagggaggcagaagttgcagtgagccaagattgtgccactacattccagcctgggcaacagaacgagactcagtctcaaaaaagaaaaaaaaataacatagctatatatgtgtgtgtaaatcaggcaccacaggttttaatccctaatttttatctttctggtattttcttgggtaaattaatttcttcgatcttcagcgacttcttgctttaaattgtaaaaatttaaaagctgttatcaaactggtcctgaagtaaaaacatactgtaaaccaaaaataaaaggctaactccccctccaaagggacttcctcctcagccagggctcttaaaatttaacctgaaagactggttcaggccaagaagggaagtgggggtcagacatgcctcattatacctctctgacacttacatcaacacagactttaagtctgataagaagcactctacagcctcttctctctgaagcctgctagctaaaagcttcatctacatgataaaactttggtatccacaatgtcttatctcaacccaaacattcctttctattgatcccaggtctttagacaaactcaaccaattgtcaaccagaaaatgtttaaatttacctacagcctggaagcccccacccccacccagttgtcctgcctttctggaccaaaccaatgtatttcttttttttttttttttttttaattttatttttttcagacggagtctcgctctgttgcccaagctggagtgcagtgacacaatcttggctcactgcaacctccgcctcccaggttcacaccattctcctgcctcagcctcccgagtagctgggactacaggcgcctgccgccacgtctggctaattttttttccctatttttcatagagacggggtttcactgtttcagccaggatggtctcgatctcctgaccttgtgatccgcccgactcagcctcccaaagtgctgggattacaggtgtgagccaccgcgccaggtcaaaccaatgtatttcttaaatgtacttgattgatgtctcatgcctccctaaaatgtgtaaaaccaagctgcaccccaaccaccttgggcacatgtcgtcaggacttcctgaggctgtgtcacaggcgcgcgaattccaccttggcaaaaatcaactttttttttttttttttttttttttttttttttttttgagacaaagtctcattctatcacccaggctggagtgcagtggcacaatctcactgcaacccccgcctcctggggacaagcaattctcgtgcctcagcctcccgagtacctaggattaggcaaaatcaactttctaaattaactgagacctgtctcagattttctgggtctacaatacaaatgctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatcaccttaacacaggttaatagaaatattctcttaaatgatagatgaaatcctgtcagagtaataaatctatgatcatacaatataatatactcaagttgaaaatcctgagtcatatattttaaaatcaaatgtaaagtttatttaaaatgatgaaacccaaaagctgcctatgtccttatgataaataaatgtgggtcactagagggcgcacattccctttcagagcttgtcttcaatttggcttctttcgttttcttatctgcataacgaaaatatggtgacaaatgaaattttcatggaagttttacttacacagaaatataaaatgtccaaagatatagataaaatagtgtacaaataatatgtaagtaagacactctcagatgcactgttaaaatgccttcagccattttgaggtacacacaaaagtaccttgaagccataatacatagaatcccttgagaaaatatgtccacagtttggagagtcatgcttagttcaaataatttagtaaaattttctggattatgtagcaagtagttttccttcccaagttcattgattttaactaatttttgaatgtttagttaaatatgtggacactcgtactctaaaaatctgcttaaaattatactcctaaatcacctaaagttttttaaaatgccaaactttcattcaaatttaaagaacagaaaagagacatatatatcattttaagcatcttaatcaggtcacaggctttcaaaaagaaaacttaatcgctcaagaaaccttgtatgttatctgtaatagcttttatttttgcagattgatcatgaatagaaaagttgaagatcttcatttagtttcaatacacagtgaagcactgagtcaagactcaagaacaggtctgtctgaatccaaagatttctacaacactacatttttcttttgttccaaataaacgagaaacccatcttaaaaaaaaaataaggataagtcaatatagaattactgttcattgctacacagtacagtaatttagtggttttgactacgctatcttggattatatgagaatttgattgaagtctctaatatcaggatattaattctgaaatttttcattaaaatatgatccttagttgtatactttgtaccctaatggcaatataaaataatttatttcccaatttattattaccttggaatttcccttaatttcctaaaatcctcaactttctaatctgatgatacaatttctcacatcagagaaaatattaagcatagatgaaaaaagttactacttattatataatgtggttaagaccatggtgagctccaaaagtcttgcacttggaaaaaaaagttcaattatatggaaattccacttatttttgatgctgaaaaagacatctaaattttaaagaaatcttttcagtgaaaaaggtctctgtatttaaagataatcaagtgttgccatgggacactagagtcaatgatacttcagaatgtagaacagacataatctagaataagtgcagcttccatagactttggcaaattcttaaggagtcccagtcaagcattttatttcagctaaataatttgatgaaatcacctttaacttattacaacatagcaaggcgaggaatttccgaaggcaacaccctaagctaggctgtctgggttcaaatcctagctgcgatgcttcctgtaaactatgtgaccatgagcaagtcacttgaaatttctatgacacattgttatcattggcaaagagtgacaataataaaacttacttcgtaatgctattttaagtgtgaaatacattaatatgtagcaaatacttggtagaagccatatacatattagctattgttattaatatcttccatgatccttttttaactggctttaagccctatgccatttctcactttctcacgtgtgagagtagtcatatttgttttagtgtcttcttaatgactgataaagtaaaagccacaattggaataacaagaataaaaactgcaaacacagctataacaaagacaatgaaacatataaacaaaaatcaacagcaaaatagtctcattttacccattagtgccggaatccccaaagtatgttctatgggacaaatatggtctgccatctaatttggtaaataaaattttactggaactcagtcatgctcattcatttatacattgtttatggctgctttctagctatagcagcagagttgagtagttttaaaataaattttatgatacacaaaacctaaaatatttactctctggccctttagagaaaacttttctttcccccttcccagtctatgaaaccaaggtaagatggcctctctctcccaactctcaagtgagatcaaaatgatatggttcacagtagccatatcatatttctctctctcaaaaatatgcaatggctccccatgaccagaaggtttaagtctacatgccttaatcttttattgaatacctttagttattatgaactcaacctaccttttcaacctcattccttacttctaaacttcctttacttcatacttctgctggaggcaaacaagaatacttaatcccatgtaagttttgttcgcatacaggctttcccctgcaatgaattgtcactttcctcatcttgagcccaatgcttccctactctttaattatccagtcagatgctaattttcccataagtcttccatgcctctcaagcaggaagtgaacttttcttccttaaaacttttctaacattttattagtacttcttcatgacagtttatgctgggtgcaagcttcctgagggaaagcttagatttacagttaaagtaactggagtgttttacataccatagcaatccattagatattagttgagtgaataggaaaattagcatgaaaactaatgttgctgtctcttctttcttgaaatgatgtggactcataatgactacagaagtgttcaaagaaacccaccatgcattggatgatgacttggaccctgtgggaggcaatttaaactttaaactctctcagtgtgaaaggtccttgagtttaagagaagtcaacatgcttgtgggtctttcaagtttaaataacttccaacccgggttccaaaaggatctagtgcaatgtggaaagccatttcaatctgacgtgtacttaatgccccactgccagcatcatgacctgtttcaatccatctactgtgttagtaagcatcactatgaactttagtcaaaacagaagtaatactcattgcttaacaaagccggtttttagtcagctagcacttacataacaaaataccatagactgggtggcttaaccaacagccacttatttctcgcagttctataggctacaattccaaaattaaggtaccagcaggatcagttcctggtgacagccttcttcctggcttgtagacagcctctggtatagtttggatattcgtcccttcccaaatcttatgctgaattgtaaactccagtgctggaaatggggcctggtggcaggtgtttggatcatgggagcggatccctcacggcttagtgctgtctttgcgatagtgagttctcctgagagaactcacttacaaatgtgtgccacctccccctgcactgtctcactctccttgtcccattcttccatgtgatgtgactgtttcccctttgccttccatcatgattgaaagcttcctgagacctccccagaagcagacgccaccatgcttcctctacagcttgcagaaccgtgagccagttaaatcaattttcatgtaagtcactcagttgcaggtatttctttataacagtgcaagaacagcctaagacaacctccttcttgctgtgtcctcccaaggcagggagaaagagccagcaagctctttgttgtgtcttcttataagggccctaatctcctcagaagagccctatcttcatgacctcatctaaatcaaattatcttccaaagtctccatttccaaattccatcacattggagattagagcttcaatataagaatttagggaggacacaattcaggccatcccagcctggcatcatttttatatctctgtggtagcataatatgtgttcatttgtaaagagacaggtttctgaccagggaagactttactaagaatactctcagaagatgtcagaataagaataatatataaatgtggtcatgggaagataccatccctgaattaataattggaaactcaactttctcctggggaaaggagacattgttttttaaatgtaaacgttcttcaagacaaacacatgtaatataatttccacagtgtgagggcaaacagggaaggccatatacattccatttcaggggtgacgaaatagattcttggggagattaagtggcttaagtcacatagtttatgagcagaagatgcacggccagaacccatctgtgcagtaatatgcccatctgctctcagatctattccccacatttcttctgtactttctgtattagagggatatacatttcccaacaccacttgccctcctaattgttcatttggaggcaatggcagaatattggaaggtgggaggaagagaaaagccaaggtcttttttcttctccaactaccttgggtggcatttctagagcagatgtatctctgctgtggcttctgttttctctggatagctagctccctcttcaacaatccaattttctgcctggcagtcctaactttagtttaatctctgttagaaagccccagcttctgagctctggtaatatcactttttctgtattgtttctccagctctagggatattagcagcttccttacgttactagtgctttgagttgcctctccatcccctgcgctgcgtctcagttttctactacctgcttagccaattccttatattacgtttcctctctttaaatcacagtgattttgtttttctgacaagactcgcacaaaacctggaaaatccctcatcaacatccaataaatatttattcaatacctactatgagctgacttctgctttatgcattataggtgtacagatgacaagaaatgatttcttccctcaaggcgtttactggagatacaggcatgcaaaaataaagtcattaccatacaatttggcaagtgttttaatagaagtgttaaaaaggctgagaagtggcctggcactgtggctcatgcctctaatcccagtactttgggaggccttagcagtcggatcatgaggtcaacagatcaagcccatcctagccaacacggtgaaaccccatctctactaaaaatacaaaaattagctgggcatggtggcccttgcctgtagtgccagctacttgggaggctgaggcaggacaatcgcttgaacccacggggcagaggatgcagtaagctgagatcgcgccactgcactccagactggcaacagagtgagactccgtctccaaaaaaaaaaaaaaaaaaaaaaaacacacaaatggctgagaactgcctctgcaaggttagataaccagaaagacaaggtggttagtagcacggtggcaggtaacatgggaatgggaaaaagaaaggtatctaaagagaatcttaggcagagaaaacagtaggtacaaagaaacagaagcttaagaaagcacagagcatttggagatcaaagagtggttaatttaagctaaagcatagggcagtgcggaacaaagttcagactttagcagacagtgaactgtttgctattagtctgtaagaagaaaagagttttcaccagagtataaatcaactgagtcactgaacaaacgatttgatcttattttgcttttaattgccgaactttcttgacaaaggaaggagtacattgatttatattctggctcaagcttcttatctcaattgtggactggtactaaaaagtttgcagattatttggagtagcactggtattttttttaaaaaaggagcagaggagaagggagtgaagctggagaggtaggcagctaaagatcacaaaagaatttctacgccatgcatttcaagatttatgggcaggggaataatctaattaaaactgcattttaagatatccctcgggaggctgtaaaaagcatggataagagaggtgagatcagaggcagagaaatcagttaaaaatttcatacagaaaaatttcagttttaactagagtgaaggcagcaaggatgtagaaaaaaataacaaactaaagagaatttaacaggtacatttggagggatttagtgatgtggcagatatcaagaccactgtgaatggctgcacaggttgctcactgcacaagttcaggatgtaccattcttagagactatgatgtgaatgaccctctctagagttatacgatctaaactccaaaactatattttagattccagtcagaaatccaggaatacatagcctataagcatttgaattatacagggatgaacatcaggagagagggagaggtagaaatatcaatttgtgaatcaaaaatataggtgatgataaagattataaatgatatttccccaaaaaataaagcatcataagaagaaaataaaatcacaatttgagtcttatgtagactgacattaaagggcaggaatagaagacagggaagatatactctgaaagaaaacaggagagaacaatgtcccagaaactgcaggagagaaaaatttcaagaagggactaatcatttctgtcaagcacaagacaaaggtcaaaaagggaaaagaactgaagagtgacctttggagctggcaattaaggagctctctggcgaccttgctgagagcagtttcagtgctcgatgtagagtatgagagggtaaaggaaagaatcaggagtccgtaagggaatacagatagttcaggtcttctgattaaaaactgacttttatttgcactcaactatgcttctccttttagatgaataagtatgagtaccattttcttcactcaaaaaacgaacaaaattatatgtaacagctctgggaatgtgatcctgtcttctttcgtgttgatattcttttacgccttgcattctggaagaatacattttcacatagctactgtagccagacatccaaagatatagtatctcataggaccagttctcaatatagtgcatttctattcacagcttgaattgagcatctactacacagaagacatcacacaggtaacgaacaagaaatggatcctggcccagggaagctttaattctagtggatgaaacaagcatatggatagatcatttcatcataaagcagtaaggtgtcacaagatgcaacagtagcatcccttaacctgcccaggaatagatggcccctgtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaagcccctttatgggggctgtcataaggaaagagaatcaggggtcagactgtaaatgacaagacactccagtgaactgatttccaaagtgtgggccctaaatcagtagcagcagaatcacgtgggaccttgttagaaattaaaattcttgggcaccactccacgcctattagaattagaaactctggtgactccgacgcatgctgaagcatgagaaccactgttgtcatgccagtgcgagggttctcaaattttatggtgtataagtatcaccgagagtgcttgtaaaatatttttgggcccaccagcagtgtttctgattcagcaggtttgggaagggccctccaaatctgcatttcaaagaaggtcccaggtgatgatactgtttcatgcactgcagtttgaatattactgttctaagtattctctgatcccatagcattctctagaattcacattactatattcttcaaaacactgctattgatttattcttgatgcataagacaacataatctcaagaacatttaatagatggttatctttttgaggatgtgaagatggtatgcaagatttctatttcttttttttttttttttaacaaaaaatagtgtctaaagcgaaatttgaatttatgaccaaggtcattttcctttaatacataaaaagtaacatgacattgcaactataacactagaatggatttaggagagtcagcaccagtccttattttgcaactgaaagcaagttatttaacctttctggacctcaattaacctgtaaacatgcataagtctagtctccttaggaaaaaaagaagcaaatcatctaaaatgttttgtttctatgggctgtgccaataggcaaaagtgtcattactgagtttaacatcccagatattttaggatcaatttatcatatagaacattaaaaaaaaaaagttcacggacacattaattatctaattaggtccttcaaataacttggtatattttgccatacaactttcagattttagtttagaaactgaagttataatcaatatctaaaacaaaaatgttttaggcatgagtctcacaaaactgcagagcggtcttatctgttatctattttctttccagagatgtgacacaatttaacttcatctggacagcagccataaaaagaaaatcaaacaaacaaaaaacagaaacaaactgaaaagtagaatatataataataattcaggtatgtagatcagtcaatttatcctcctatgtagttaggatgcaggaaatagccgagaaagcaagcttacattctgtctgcttaccctggagggaaaaaacagaccaggtgaactgaggcatttcaaaatgcctctacattatccttgaggacaaagatattcatttatgaacgctttacttgggggaaattatctttattaagatggcattcacttaaaaacaatttgccattcattctgcctggttgctacaaaagtataaattaaagctttttttaaaaatcccttaaaataactgctacatgattaggaagtaatctcctggataaataccaattaactagataatagatctagttttaccctaggctgagttccttactctgataattacctacgtgtacaataatatcactgaattgcaggaataatttgctattagaaataattatcttgtgacccaagatcatcagacacttttgcaaatctcagtgtaaagagaaaaatttatgcaataaatacaacatatgtagaaactgtataattatttaggaatcgactaaatgtaccttagatagttaagaaactatgtggtagaaagctgaattttaaatcccttaattgttttgggtaaataaggataccctaatgggtaaaattggaattattaaagatcatcaggatggtcacgtttattattaagaacaattccaggaagagctaggtagaatttttaaatgatattgaaatgtcaaattttagttactgcaattatttgaattatataccattcactctctcaacaaacatttattggttacttattgtatccacggtatttgctacaatggaatctaagtaaaacataaagaagtgtaataataggcttcctttgttttgacgggcaatgagaaattttatgtgagtggcatgaaggcatacaacaaaacgaatgtaatgtaatttactggctgaagtggaataatgattattgggaaggtagacataaaattagtggagaatgagaataatactgaatgccataggaagcacttgggttttattttggaggtatctggatttatgggaattcgcatgtctggagagacatcaaaaagcatcattttagatatattcattttagtaaatcaattagaaaggagggcagttctctccacagtgaggtatatggctcaggttatggacttggcaattcgaatgaacatgaaatgacggaaatgatggcacttgcccaataatacaatctaattataataaataaggaaaagaaagtagaagaaaaattcacagaactagagatgtcaggtggtaaattctgttttgaagaggaaaacaggaaggtaattttacatttcttaggtttgagataatgtttattatggaatttttccctgtcgataatagatgactaccatctccatcactacctccaccaccatcatcatcatctctactatcgttacctctcccaccatcacttctactcctcctacccaccacaatcttcctccatcttcatcatctctatggtctccaccaccaaataagaatcgaaccactgcatttattgaatgtttaccaccttaaaggcaatgtattaaatgcttatttaatcctcatgacagttgttttataaagtgagaatactggaatctgaggcacagataacaagtaatttgcctgcgctcataagctagtaattaaaacaggcaggtttcacaaataccacaggttcttacctataagtgagagataaacactgagtacacatggacacaaagaagggaataatagacactggggcctatttgagagtggaaggtgggaggcaggtgaggatgggaaaactacctatcagatattatgctgattacctgagagacaaaattatctgtacaccaaacagccacaacacgcaatttacccatgtaacaaacctacacgttaaccccttgaacctaaactaaaagttgggaaaaaaaaaaagggcagcattcaaacctcagtaattctgattccaaaagcaatgattttttccatatttgctacttctctagacacacaggcaatgaattataactaaaatatgtgtgcaatgtataagtaggtatggttaattggaaggaacaaatgtttgcatttgatgaacattgaggcagttgctggatgcacaagcggaaatagctttagagatataaagctttaatttgagggagagtgtcacatctggagctacatgatttgggagtcagtcacttagagccaggctcgaatcaatgagaggagataatccagataaagaagtcaaaaggccgggcatggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaattccagctactcgggaggttgaggcagagaattgcttgaaaccaggaggcggaggttgcagtaagctgagatcccgccactgcactccagcctgggtgacagagcaagacactgtctcaaaataaaagaagtcagaaaggcaaagagatggatctgtgtgatactcccataggaataaggcagaaggaataaaacaagtcaggtaaagagtcgtgggtgacaactggtagtgtgtcacagaagctggaagaggacatcatttaaataaaacactattcaacagatggtcaagacctcaatattcagtgaaatattagtgggcttcagatgatacaaaaacggggcactagctaatataaagcttatggttatatttgcatgatgcctctttaatcattacaatactttaacaagattccaccctgtagacaattatcaattaatgaatttgttcctaaatgtttgcctttttgctatcttcgttcagtctaaatttatcaatcaagtgtcgtatatagcgtgttcagataattttgccgtccaaatcaggacacacttgagagtgaaagttgatgctatatataattatgctgggacaacaggtgtaactgggatggcttcaggtaaatcaataggattaccttagtcatatatctatgaaaaagacattttactatacagcccaggttttgtagctacctcagttcaaatcctgtctgaggtacactgtagctgtgtataattttataaagtaattatagccatacctattttgggaggttactgggaaaaatacatgcgatgccaataaagcactgaatctactactgagcacataataaatcctcaatttatgttagcttttatttgaagaatctttctgtatgtgcccaatgggacttctcatttaggcacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactggaatgaaagggaaattgtaccttttaaaataatttttatgccagctttgcactcataaaattttattgccatcattttaatatatccactgatttacataatacctaacttatctaaaatgcataattctgaatagtcacaaaaagatcagttaaaaattctaacaccttcaagataagactttataaatatcaaagaacaggaaatgtgttctgtaattactcctgatttaggatgcgcagactgagacatcatgttctcgtaaactaccaggatggatcccatctattataggtgtacttcttcatgaaaatgcactttccgttactggaaaaaaaagacatttaatgcaaaactagggactcaacaagcaggccctttataaggaagaaaaaaaaaaaagaaagaaagaaacttttaggattaaaatgctaccacagtagtttatcacctatagtttctatagtttcttctttcaccccagaaaacaccatttccattaagcatttactttctgttgcgatagtgatttcttgtgaaagttttaaaatgtacttcataatttttctcactacattaactgacattacaggtacccgaggattctggaaatattgctgaagtgaaaacaccaccaacaaaactgctgtaaatgagttttctccacttcatttgcagataaaagcttaagatgctctcaccttttcctaatttcagaatccacagtaatctgcctcttcttttggggaggtggtggtggaagttcctcttgagcatgctttaccaggatctgttcccttgtggtcaccgtagttactgtttccattacagttgtctgtgttagtgatggctgagtggtggtgacagcctgtgaaatctgtgagaagtattgaaacagaggtcagacattgctagaaagacttcagtaaagactgcttggagtggcaaaggaaaataatgagaaactgttcttgcttgttggtagattgaccttcagatcaaaatagcaccatattgaagccaaataaaattgttttatctgacttaagtttggttcactgaaatagcaagggaaagtaatctcaacatcgaaagtcaatttagcgccccttcaatatattggtcaaactgtaggaaataaggggtgggggcagaggagaaaaatgtagagtataattcattctgatagttaattctacatgctgtttaaaatgtttacattaatatgaatgttactaacgtacatcagtaccaattccattgcctagaacattttaaatgcttattaatagtttgtagaatgcatttttggttatcatacacattgattattttatgttatacatttttaaataaaattatttcaacttggtaatgaacgactctttaatcaaataagtgaaacagcttttaaaattacaataaaaggttaacataaagtatgtattagtccatatatatctttatgttgaatgttattcaaatgctaaaaaacacactactcttgtttgatttaaattagtgattatgttcaaatatttgagttcccatattcatcactggagacacttcttggtttagaatctcaattacctcctgttcatacttttggcagcgggccgggggcaacagttcatccatctttggaataatacattttgtgagccaagacatgagaggccatcacctcaatacatgggcattacgagatagacaagtcatataatggtgagacaatcattccttatcatattctccgtctcacagagctcctctcatgacgattgtaacgttacctcttgggatggtaatcattatccttctggcaatccaacttatatgcaaggtctgtttccaaggaagtcacaagaggcctgcattgaaactgcctctggttacaagcaaaggagcagggatctggctgggtcaagattcattttagcaattttcctgaatttgccaagaggtaagggaagggtttgtagtaatctccctgcctcatacacgaggactgattcctttcatgtgaggaaatgggaaaagcctcaggatcttcttatttcagcttccaaattggcaatgaacagtgaaggaataaaatcttttccatgatgtcttaagtaaaaattgctttgacatacatagcttaaaaaggctaccttttgttaaagacatatctttacctatgtgagggactgaaggatttccattttggtaggctaaaaggatactaagaattacagtttctacatttgccaagcacaggttttatcttctctaggatctccatagattcattatttagaatgaatcactgaacctcaaacaactttaattataagtctgttgacaagttatgtcaagatgaaagcagaaagcaacatagctctaaaaaaagcttaaaatataaactcaaacattgcacccaacacaaaatgaccattacgtgataaaattagttttatttctagtcaaaaagaaaatgtagtttttagtaggattccaagagcatttactttgtaatttgaatattttttaaccatgagaaaacttgctttgcaaagaaaatgcagtttttagtaggatcccaagataatttatttttttatttgaatatttttttaaccatgagcacactttctttgcatacagtggaggctagaagataatattttgcagattaagaaaatacctaattttaaacatacagaccagaatgcagagattctgaaaataccaagctaattcatgcagttatatccaatctcatagaacatttgtgctactaaaaatttgactcttaaattaatttctgtaatattaatattttcgtggtatctacttataaaattggatacatgtgcccatggagggtaaagggaaatgacaacatgatatactgtgaagcggcatttaaaaatatactcaaccttttaagaaagaaaaatgaatcatttttaataaaagagtagtaagacatgagtctgtaattgttctatataataatcactactacactgtaattgaaaaatactacttcatttccttcgggatggagaaataagaaaactgtgcattcaccctgtaaatatagggtagaactcattacatataacaaattaataatcactctcaaaacctacttcatacaatcagaataaaaaacaatcagtcatgtactaaatttccttatggcttatagttattgactataactattattgacacttaattatgtgttagaatcattaggaaatatagacaggagagggactacgaaggccatttaacatgacctcctgattattacagagctcactactccctgaaacagaaagctcctttcttagcatgcaagcaaactttccccattgggaaagatgttcttaacaaccagaggaatcctgcctgattaagacttcctcttgttaaaacttgttttgagttctgaatgaaagcagagtaaattgaatatcatttctacctgatattctaagatttgaaatctaataatcatgaccctgataaatatcattttcaaactctataatgccagttatttgctagaagtagatataacttgattcgtcatccaaaaccaatgtttcttggctttggacaccatagtcaatcaaagaattctaaaactgtgtaagttattcagcagctgaaccacaaggtttctataaaattctaatgtttattgaatatatattcactataggacattcagaaatgagtaaaatagaaactccatatttaggaaccttacggcaaaatagggacgatgataatcacacaaataattgtgaagatgaatgccacgtgaaaaataccagtatgcaaaataattacatacaccaaacatacagtaatcaagtaattttctctttaaatgttatgaaaacagatttctctcagctagcattttaacatttagatttaatttgatgctgaaggctagatataatatttatccttgtttatagggtctttctaacagtaacttttggaaacaacctcatgtcatagatgatggtttaagtacattatggtatatgaatgtggatggagtattatatttcaaatattttaatgtcattggaaaacgtttgctttacactattgagtaaacaatgctagacataaacattggttgatttttgacagagaaagtagagaaaatttctgttgcacagtgtatatttctgtattcctttagtttccaaagttcttctataagatattatctgcaaaatgttgcatttgtaagcaaagaaaaattttgaaagttttgccaaactgtttgttttaaatctatcatttctatttatatattaagatctatggaatcatactcctgtcactcaatgcattagaatgaggaaaacttcaagcatgataagaataacgtagtgccttcactaaaatgtttaatatggcagagtcaaaactagaatagaatatagtttgacctatattcaacaatctttgtatctagctaactatacttttacccagtcacctttcttcattttgattatgagtctatttaagactctaaaatgatatcatgaaaagaaaatacatttctttttaaaatactattcattttaactgcaagttaatttccctagtaaaaatgggaaatagtttagaaatacttgtctttacatttgggagctgattcctcttagagtggttataagtagaggcattggagccagtctccacaattattaaacaccagatccatagtttatacactgtgacatttggggctggttggttcttatctcaaatctatgcattattttcttcatctttaaagtaagagtaacacatttcttcacaggtgtgttacaagcaaggacagcttcatgggctggtaatttatgcagttgcccagggcccctgctcaggaggcttccatgcttgttttcaagctctgcttccactgtcttgaaattcttaggtcttgaacaggaagcccttgttttcagtttgcactgggcccacaaattatgtagccagtcctggttttgagaattaaatgatataatatctgaataaaataagtgctctataatggtaaatatcagcagtaaccactatcttttctaaacgctcagggaaatttgaagaatttttctatactcaaccttcttactcataagattacatatgttaaaaagatttaaactttaaaatttacattttctcattctgagaaaaattggaagagcatttgccagcatcctgatattattccagggtgtgcctcttcttgcagtaagattgtgttattttgataggcctgggaaaaacaaactatgctcaagaaatgaagttctttctttccatcttctcttccacttgtttaaaaaatgcacatttaaaaaaagaaacataagtacatcaaagcaaatttaaagaatacaaaaggacatacaataaaataaaatactttttttctaccactgtctccagtttattaggaatcactacaagtcatgtataacttaacaactgggacacattctgagaaattcatccttagacaattttgtccttgtacgaacgccgtggagtgtacttacacaaacctagatggtacagactactatacggccaacctatgtggtacagcttattgctcctagctacaaacctgtacagcatgtgactatactgaatagtgtaggcacaatggtaagtatttgtgtatccaaacatatcgaaaggtacaataaaaatatgatatagagagttgggcataaaacaatctttagaaaatttttttaaaacccacaaaattataccaacaacactcttggaccacagtgcaataaaaatagaaatcaatgttaagcaaattgctcaaaaccatacattaaaatggaaatcaaacaaactgctcctgaatgacctctgggtaaacaataaaattaaggcagaaatcaagaaattatttgaaactaatgaaaatttaaaaagatgtaacataccagaatctctgggacacacacaaagcagcgttaagaggcaagcttatggcacgaaacacccatatcaaaaagttagaaggatctctaattacaaaacgaacatcacaaggaacgagaaacaatagcaaactaaccccaaagctagaagacaggaaataaccaaaatcggagctgaactgaaggaaaatgagatgcaaaaaagcacagaaaaggtcaatgaatctaggagctgtttctttgaaataattaataataaagatagaccactacctagaataataaagaaaaaaagagagaagactcaaataaacacaataaaaaatgacaaaggggatgttaccattgaccccacagaaatagagaaaacccttagagactattcataatgaacacccctatgcacacaagctagaaaacctagaagcaatggataaattgctagaaacttacaactttccaagtttgaaccaggaagaaatggaatcattgaacagaccaataatgagttccgaaattaaattaggaacaaaaagcccaccaaccagaaaaagcccaggaccagacagattcacacctgaatactaacagatatagaaggaaaagctggtatcattcctatgaaaccactcccaaaaattgaggagcggctccttcctaactcattctatgagggaagcattgtcctgataccaaaacctggcagacacacaacaaccaaaaaagaaaacttcaggccaatgtccctaatgaacatagatgcaaaaatagtcaacagaataccagcaaacccaatccagcagcacatcaaaaagctaatccaccatgatcaaggagcttctatcccagggttgcgaggttgattcaacatacacaagtcaataaatgtgattcaccacataaacagaacaaaaaatcaaaaaccacatgatcatttcagtagatatagaaaaggcatcctataaaattcaacaccctttcatgttaaaaatcctcgacaaactaggcactgaaggaacatatttcaaagtaattagaaccatctttaaaaagtccacagccaacattatactgaatgtgcaaaagccagaagcattgtgcttgaaaactggcataagacaagggggccctctcttacaaatctcattgaacatagtactagaaatcctagccaaagcaatcaggaaagagaaataaaggcaatccaaataggaagagaggaagtcaaattatccctgtttgcagacgatgaggttctatactttggccatagtctctgcccaaaagctcattgatctgatacacaacctcagcaaagtttcagcatccaaaatcaatgtataaatatcactagtgttcctacacaccaacaacatttaagctaaggccaaatgaagaacacagtcccattcataattgtcaaaaagaaataagatacctaggaatacagctaagcaaggaggtgaaacactgctaaactgagaattacaaaatattgctcaagtaactcagagataacacacaaaaaatggaaaaatattctatgctcatggaagaatcaatattgacagaatggccataatgcctaaagcactttttaattcaatgctattcccaaaaaactaccaataacattcttcactgaataagaaaaagactatttaaaaattcagttggagccactaaaagagccagaatagccaaggtaatcctaagcaaaaagaaaaaagctggaaccatcccattgcctgactgcaaactatactacaaggatatagtaaccaaaacagcatggtacaaaaaacagacacataaaccaatggaaaagaatagagagtcgagaaataaggctgcacacctacaaccatctgttcttcaatgaaatcaacaaaaacaagcaatgggaaaaggactgcctattcattggaccccttccttacaccatatacaaaaattaacccgaggtggattaaagacttaaatctaaaaccaacaactataaaaacctaagaagataacccaggtaatgccactctggacattgaaactgcaaagacttcataacaaagacaccaaaaacaattgaaacaaaaacaaaaattgaaaactgggacctaattaaactaaagaacttctacacaacaaaagaaactatcaacagagtaaacagacaacctgcagaatgggagaaaaattttgcaaactttccatctgacaagggtctaatatctggaatctacaaggaacttaaatttacaagcaaaaaccaaacatcaccattaaaaagtgggcaaaggacatgaaccctttccagaaaaagacatacatacagaaaacattcatatgaaaaaatgctgaacatcaataatcattagagaagtgcagatcaaaaccacaataagataccatttgacaccagtgagaatggctattattaagaagtcaaaaaatcacagatgctggcaaggttgcacagaaaagggaacgtttattgcactgctgatattagtgtaaattagttcagccaccgtggaaagcagtttggtgatttcccaaacaacgaaaaccagaattaccattcgacccagcaataacaattattgggtataccaagaagaatataaatccctcaaccctaaagacacatgcacatgtatgttttattgaagcattattcacaatagcaaacacatggaatcagcctaaatgcccatcagtggtagactggataaggaaaatgtggtacatatacactgtggaattctatgcagccatgaaaaaagagattgtgttctttgcagcaaacatggatggagctggaggccattatcctaagcaaactaacacaataacacaaaatatcacattttctcacttctaagtgggagataaacattgagaacacacggactcaaagaaggggacaacagacacggtggtctatgtgaggctggagggtaagaggagggtgaggattaaaaaaactacttattgggtactatgcttattacctgggtgatgaaataatctgtacaacaaacccctgtgacatgcaatttatctatatgacaaaccaccacatgtacctctgaagcaaaaataaaagtaaaaaataatatagtataataatattatgagaccactgtcatatatgtggttcattgttgactgaaatgttgttatgcagcatatgactgtagttgcaattacgaactattcagctattctttaattttaaattcattttgtttatgctgttattttatgatatggtttggctctctgtccccacccaaatcctcatgttgaattctgtcttcagtgttggaggaagggcctggtgggaggggactgaatcatgggtgtggacctcccccttgctgctctcctgataagagttctcatgagatttgtttgtttgaaagtgtgtggcaacccttgccagatcgtggccagtctgcttctttaagtgggaccctgatccatcctcctcactgggtgggacctccctgagggggcttcagccattccacccaggattcaatggatagagctctgatctctccctgggacagagcttctgggaggaagaccagctgccacctctgcagttctttgaaactaatgagaacaaagagacaatttatcagaatctctgggacgcagctaaagcagtgttaagagggaaatttatagcactaaatgctcacatcaaatagctagaaagatcttaacagcctaacatctcaaataaaaaaactagcaaaccaagagcaaacaaacaagaaataaccaagatcagagctgaactgaaggagataaagacatgaaaaaccctccaaaaaactaaatgaatccaggagctggtttttggaaaaaaataaaaataaaaaaggtagacttctagttagactaataaggaagaaaagagagaagaatcaaataaacacaatgaaaaatttgaagaggaatatcaccaataattctacagaaatacaaacaaccatcagggaatactataaacacctctatgcacataaactagaaaacctagaggaaatggataaattattgaacacatttctcccctctaagactgaaccataaaggaaatgaattgctgaatagatcaataatgcgttctgaaattgaggcaataataaatatcccaccaaccaacaaaagcccaggtccagatggaatcatagctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaacacatgcaaatcaatacatgtgattcatcacataaacagaactaaagacaaaaaccacatgactatctcaatagacaaccaaaaggtatttaataaaattcaacatcccttcatgttaaaaattctcaataaactaggtatcgaaggaacatacctcaaaataataagagccataaattataaacccacatccaaatgggcaaaagctagaagcattccccctgaaaactggcccaagataaggatgccatctctcaccactccttttcaacatagtattggaagttctgaccagggcaatcagggaagagaaagaaataaagggtattcacataggaagagaggaagtcaaattatttttgtattcagatgacatgaacctatatccagaaaacccccattgtctcagcccaaaagctaagacttcaaactatactacaaggttacagtcaccagaaaagcagggtactggtacaagaacagacacatagaccaatgaaacagaatagagaactcagaaataagaccacgcacctacaaccatctgatcttcgacaaacctgaaaaaacaagcaatggggaaaggactgcctatttaatacatagtgctgggatagtcctatgcagaaaattgaaagtggacttcttccttacaatctatacaaaaattaactcaagatggattaaagacttaaatgcaaaaccccaaacaataaaaaccttagaagaaaacctaggtaataagattcaggacataggcatgggcaaaggtttcatgaggaaaatggcaaaagcaactgcaacaaaagcaaaaactgacaaaggggatctaattaaactaaagaacttctgcacagcaaaataaactaccgtcagagtaaataaacagcctacagaatgggagaaaagttttgccatctatccatctgacaatggtccagagtctacaaggaacttaaacaaatttacaagaaaaaaacaaataacctcattaaaaagtgggcaaagcacataaacaaacacttctcaaaagaagacatacatgtgacctaaaacgatatgaaagaaaactcaacatcattgatcatgagagaaatgcacatcaaaaccacaatgagataacatctcacgccagtcagaatggttactattaaaaagtcaaagaacaatagatgctggtgaggttgtggagaaaagggaacacttttacactcttggtgggagtgtaaattagttcaacccttgtggaagacaatgcggagatttctcaaagacttagaggcagaaaaaccatttaagccagcaatcccattactgggtatatacccaaatataaatcattctattataaagatacatgcatgtgtatcattgcaacactatacacaatagcaaagacatggaatcaaccttaatgctcatcaatgatagacaagataaagaaaatgtggtacatttacaccaaggaatactataatgccacaaacacgaacgagtcaaacttcttttcttcataaatcactcagtttcaggtatgtctttatagcagtgtaagaacaggctaataaattttccttttatttttgactgatattcttaattgaaacttttaactttccatttaattatttacatattattgcctttgtaacttttttgttatgctgggataagagatttcaacttcttgccttttgagatattctagtatttgaatatttagatacttactagaaagattcaagctataaagtattagttactaatttagcataaaatctttattttgcaaatactaatacttgcaataacaggtaccagttatgaagctttctgcatgatccaggcattacaataagtgttttgaattgattatcttattcaaaagatctagaaaaactcccttgctatgttgtaaagctttaataaatggtagctattatgacctcacaatggccctaagagtaagtactaatattattcctattttatagatgaaagtgaccttgttgaggcagataaaactttttagtagcaaagcatagatataaatccaagtctgaatgttcattcatccaactcttatcagctatgctcacttgctcctacacttgtacacttttttgaatggtggtttccttttaaggggtgtgtatttgtatgcatacacacacatatataaattcagaatactgaaattgtaaacaatggcacatcataactattatataggaagaattactcaatgttaaatatgtttggctcttgacatgctatattgaaatctgtgcaaaattagtcaaaatacactacacacacacaatcaggttgacaactgtggatcaaggcttttcattgcgttgtctgtctatgtatatgtaaccctttggagtgatcaataagttttaatgggcatggaggaattgcacttctgcagtttaaaacatactgcataatcatagcaacagctttagataataattgatagccatgcttaaaaaccaactccacaggcatggtagcacaaggcacaaaaatctggtaaagatttgcatctctaagcaaaagaaaatatttatatgttgaactttgggagaatccttgggcaaaagatcagatggtcacaaaggaagctgagttactaatcacaaggatgtaaaatgctttatcttatgaagtatagaggacttcccatagctgaatgtagcatacaatgagtgccaaagttcaggacagtagcctggtaactaaaatttactattaattactgtaattaatttattattacaataatttaataataatttaatttatattaataattaatttattactgtaaggtaataaaatttcttgaataagtactgacattgaaatcatgagcaaaattattgtcaaatacttagaaggcatcataagtcatttgtttcttcgaaataaatattatatgataattaagaaggtttattctgtaaaactgtctgtccaatttaatgtattttgttcctcattttaaattgtctttagtacaaattgtatcagaaagaagagatgtatgttgtcttctggattcatattaaatacggaatttgagcaactgtgtgaattaactgcacctgcaaaaattgcaaagcaatgagatttaatttttctgatccatctggccttcctctacataccatctaacactgaagtaatgaaacacattctataattagggatggatattatcaagtataggcttaggaaaaagacttgtatttgtctttatgtgttatttcatttttttgtcaggagataataggcgtatcatacagatgctgagcattttgtctgtatggtattttaatgacatactcagtgaatacagtgtaataatttcataattaagtctcctttgaatagggataggatgttattatcattattttttagctgcctttccagtggcaaaagtaggaatcttcttcactaagtactccagagtttcacataaaagcaaagagaaacatatcaaagacatttagaactcgatggccactatagaaatctgcctagcttacctttcctttaaatttataaataaagaatgagagattccaagagttaactcagactgaatgtattaaattttttagtgcttacattttatattgttacagacaatgcatttacaaggtaaaacctattgcactgatatacaaggcccattctcaaatacctattatagttggagatagcaaaatgatacagttaatttccaaagttatttgagatgtaacttcaaattttcttttttttttttttttttttttttttttttgagacgaagtctcgctctgtcatcccggctggagtgcagtggcatgatctcggctcactgcaacctccacctcccgggttcaagcaattctcctgcctcagcctcccaagtagctgcaattacaagcgcctgccaccatgcctggctactttttttgtatttttagtaaagatggggtttcaccatgttgaccaggctggtttcaaactcctgacctcagatgatttgcctgccttgtcctcccaaagtactgggattacaagtgtgagccaccacactcggtcaacttcaaatttttctaataaaactttaacctgaggaattacccaaaacatgttctcaaatttaagggagttaattctatgaccttaagtaagaaggaaacacaaaataagtaaggtatttttattttaattccagattttaaaaaattattttcttttttaattggcatcaggcttactagtcgtggagagctttcaggaagcaatgaaaaggtcttttaaataaaaagccttagagtatttttaattaaacttactggccaaaaaagaagagaggcaaaccatttgcaactatatcccccttgtacaaagaggtctacaaaatgatgctctgagaatgggtacagccagaacgtgaacataaaatattttatgaagggttaaaatagaggatctttaaagaatgagaattaactcagaaaagaagaacatgtaaagaaattttcatcttggtacattggcatatttctatttgcattttgggtataataaaaagcactggcttatcatttacagctatgttttatattactatttgataggagttttaaatctcccatcaggtgcttgcttcggcagcacacataataaatctctcatcaggatatagatgatatagaaggtacacataattatataataatcattttctctttttgggcatccttgaatgtaggcacaaacatatacagcataaacatgaactgccatgtacaagaagaggcaaattctgagcatatgtattttatcttaaagaggtgctcacagttgagaatgttgcaaaaattgttgttagcaatatagcaaaatattcacaaaatgggaatgagatatttgaaccttaataagtcatacaactttccttattcctgagaaagaagacaatttattctactaaaaatccacaaaactacaaaacctttagactcgcttgaaaaaaaaaatatatatatatatgcttacaccaaagcacctggtatatactacttaatataaattacatattaaatacagtaattacaatttatggcgtaatatgataattacaattagcataccaaattgtaaagcatatgactaatataccctttcaacagcacatgtgatttcagtcaaatgaggaaagtaatgcttcaaatcacatacattatattttaaaatattaattataataaatttcttactatcacatttatttttttaagttccagggtacacgtattggatgtgtaggtttgttatggaggtaaatgtgtgccacggtggtatggtgcacctacagacccattaggtagatattgagcccagcatccgttagctatttttcctgatgctctcctcctctcccagcaacaggccccagtgtgtgttgttctcttccctgtgcccatgtgttcccattgttcagctcctacttataagtgagaacatgcagtgtttggttttctgttcccgcattagtttgctgagaataacagcttccagctacatccatgtctctgcaaaggacatactctcattcctttttatggctgcatactattccatggtgtatatgtatcacattttctttatccagtctatcattgatgggcatttgggttgattctatgtctttgctattgtgaatagtgctgcaattaacatacaaatgcatgtatctttataataggatgatttatattcctttgggtatatatccagtaacggccttgctgggtatttctggttctagttctttgaggaaccaccacactgtcttccacaatggataaactaatttacattcccaccaacagtgtaaaagcattcccatttctctgaaaccatgccagcgtctgttgtatcttgactttttaaaaatcaccattctgtctggcgtgagatggtgtgctgaggctaatatggatgaattgagagaagtaggcttcaaaggtggataataacaaacttccctgagctagaggagaatgttctaacccaatgcaaacaagctaacaaccacgataaaacgtaacaggagcggataaccagaataaccagtttacagaggaacatgaatgacctgatagagctgagaaacgcaatacgacaactccacaatgaaatcacattgtcaatacctgaatagaccaagcagaggaaagaatctcagagcttgaagactatcttgctgaaataagacaggcagaaaagattagagaaaaagaaaagaataaaaatgaatgtacaaaacgtctgacaaatgtgggattatgtaaattctgaagcaaagactgtttggggaacctgaaagagacggggagaacggaaccaagttggaaatcacacttcaggatatcatccaggagaacttctccaatctagaaagccagccaaacattcaaattcaggaaatacaagatactcactgagcagaagccagcccaacattcaaattcagggaatgcaagatactgagcagaccaaccccaacatacgtaatcatacaattctccaggtttaaatgaaagaaaaaatgttaaggacagccagagagaaaggccaggttacctacaaagggaagcccatcagggtaacagcagatctctcagcagaaaccctataagccagtagagattgggggctaatattcaacaccgtgaaagaaaagaatttccaaggcagaatttcatatccagacaaagtaagcttcataagtgaaggaagaataaaatcttttccagacaagcaaatgttgatggaattcgtcactatcgtatttcataattatgatcaagataaaatatatatcgatcagggccaaggcaattagaaaaaactgcacaaattacaagtatgtttataaaaaattacagggaatcatgatcatttgagtttttaaagaagtcaatccagggtatatttgccctcttttctcattgtaagcctccagatagcaagagttattatctctccaacatttagaaaaaaagtattttctatcttcttaggctaccttctaatcaacttaaataccctcagcttgtgtccaggtattattcaagtcaaatctgagtttgaaatgcaagagagcagtcctcctagctgattattttttcacgttttgatctcttgccatgcaactgcttcaaaaggtcaaaaatgcctcaaagctctgacctgaacagcaatcatacgcgcaagcagtgttctttatatgagtacaactgggtgccttgtcatctcaatcacgatttccacaccctgcctcacaataggttttaaccattatgagaactttgctcattctttatactaattatttaaaagaatttttgaaacaattgagtatatcatgtgagtagtcattaatgaaactcatttttctcccacaatcattatagaaaatgtacatacaagtgagctttgttcttcaaagtcacaaccttacagctcatattcttggaattctccttatgtaattttaatcaaggtcaatttaacatggataaaagaaaatcagttgctcttatatgatactatttcgctgttgtctctgtttacctccttttaatttctcttttcctgagtagctccatttctaccttcctgtgagctcaaaaacagccagcaaagatttggatcaatcccatgacagcataatttttggaaaggcaatgagagaaaactgaaacataagcttaagaaaaactcaagcttagtgttctggaaaacaacttacatgatgttaagtccttttatttatttctagcccacaataggagcgtgtaactgtttgaaaataaaattaaaaggagatagtgggccgggcgcggtgacttatgtctgtaatctcagcactttgggaggccgaagtgggaggatcacaaggtcaggagatcgagaccaccctggccaacatggtgaaaccccatctctactaaaattacaaaaaattagtggggtgtcatggtaggcacctgtagtcccagctgctacttgggaggctgaggcaggagaacggtgtgaacccaggaggcagagcttgcagtgagctgagattgtgccactgcactccagcctgggtgacacagtgagactccatctcaaaaaaaaaaaaaaaaaaaaaagcagatagagaaccacaaaaagccctccagacacactgaactacatgacttacatatcaaactcaacctttttcccctcaaatgctttcttgtctatgcctccattttatcttcattgtatccctatgagcaagtgaagagatacatgctgtaatgcatgttggactttatttcataaagaaccatgcaaatcaaaaccagtattcttttattatagaattatacaagttggaagacatcacgtcaattgcctaggtggtggtctcataatttctagggaattaaaaataaggcttcaaatgcttttctaccaattggaataatcaaatcagtaatatttcgatgacatgtacaaacttcatcaaaaagtagtcccattccaagggaatgagcatatttatatagtgtattcccaagaagctctcccttttcacatttcagggagcattgtggaaaaccagaatgttgggattcacacacatatcactgtctattttctttaaacatttattttaggctcaggagtacatatgaaggtttgttacataggtaaatgtgtgtcacaggggtttgcttaccaattatttcatcacccaggtattaagcccagtatccaatagtcttatttactgctcatctacttcctcccaccctcccacctcaagtagatcccagtgtatgttgatcccctctatggtctgcagattgtatcaaaggcttagtaaagatgtagatttttaggtccttatcacagcttatggatgagattttctgagcaaaatgtttaggaatatgcattttaattagctcctcaggtggctactatgcagactcaagtttgagaaccactccatgcaatgcaaatgaactagaagatgacctacagttaactgttacagctccctaaacatgtcccttaaaagggatgcacgtcaaaataactttctttatcaaataatggcaatctttcttaacacggcaactgaccattttatggcagcaataatctgtggaagcaatgggtacatatgggaatactctcagtgttgggttaaaaagtatcaaattgactaatgtctcatgtatttattacataaataccaatgtattgcaaagaagccatgggcagatcacataaaacaggaggaatcataatatagtactaaaactactattaggtcaattaattgctaaagtatgtttaatggaaaacaaatggagtttttattatgtaatgattgtgtgggaaattattacaatttatattcatatttcttcaaattataattttttaacgtaaaattggattaaaagtaacattgaactgtgattgaaaatcatataggctggtttattacgctgtcttaaattgtattcctggaggcaatactacaaacttcatgtctccaaaaggcatttcctaagtgctacttatcagatgtcaggtctcaagaaaacaaattccatgtacttgtctcaatatagaggaaatatttgcctaaaatctattgaatatggaagtgtatgcctgtgcattgagctatgaattttgagtaaagttattccttataatgccaggctatgtggcagaatatgttaaatactattatatataatgtttatatcttgaatgactactcattattctaccatccaactacataagacaaaaagaggttcaacttttaacgataccccattttagtgactaaatctttaaaaattattataataaaaccacataccccaaatgtagctgagatgttttcataatctacagcccgtatgtgttagtataactaagccacattcataattttatgaaatcagcagtctatggcagaaaaggtacaatagtcagataattaactacactaataaaaaactttccaagaaatcaaaagacctgaaccctagttctcctaccactaacttctcttgaaaaatttacttttcttccctaagtttcatttttctcaagagtaaaacggagttggctaatgttcctcgtggttctagcaatctctgatttggggttagactgtgattatacagttcccagcattttgttcgcctgctctaagtcactcagttccccgttactattgggctggaagaaattcactctagggcagtaacaagttcagttaattagcactctacctcaccaccattctccaacaacaagacaggcaaaagaatcatgtttttatttaactaaacacagggcaaaaactaatctggttgcttcttttgtagggttataatgtcactctcttaatgcaggtttaaaaaatctctgagatagtctgtagcatgataattggtatcactaacctgtgctgtactcttttcaagtttttggactaaattatcccaacaccgggcaaagttatccagccatgcttccgtcttctgggtcactgacttattcttcagtgttgaaagaagatcttgtttgagtgaatacagtttgcccatggattgctttttcttttctagatccgcttttaaaacctgttaaaacaagaaagatcacagaataagcctgggttgcattccatacaccactatagttcaatctgcttttgcgtgtatttgctcatttgcatagataagaaaatatttcaatcgtgcccgcaaaggatcaaaagttcagaaaaatagaggtagaaagttataatctatctaattatcccaagaagtttgaagagaaaagaagagaaaagaaactcaaacgtagaataaagacctactagaggtaattaagagctaccttgaaatatttgaagaaaatccaagtgaaaaggtaatattgcttcaaaaggcaaaacagagatcaacatgtggaaattagaaggcacggatcttggatttccccttaattcctgacggaattcaaacgaaaactgacaatcaggtaccaggagtactgaagaaaagctagtgagctgagaaaatgagaatggctaaggaaacttgccattctgaaatgctgtgattatttggataaaattacaatattattgtttccacagttttaacattcggttcattatttggagataaaatctcattatgtgatttactgaccataaaatttttgtagcatccattaatcaattaacatctggttatttgagtaattattttttaaaactaattgtagagcccattaagtaaaagaactaagtcgctgggcatgacataaatgcttcagcatctcttttcagagtttataaatacttatgtgtcttatgaagcaatttttataccatttatatttccaaagttcctgtgagctgtggagggttacaaactccctttggttgatttgaaaggaataagtggtttatgtgaaatcagtaaatcagggcagtttttcttttacttgactcagtaactttgcctgatacacagacaaattcaattcctgggtactgaacattactccctgacttaatctgtaaacaaaggagaagaaggaagagaaataaaggagaaaattatcttacagccacttaacaaccccatatttggcagcaaatacaatgaatgtaaactaaatcgcgatacctgtctttccgaaacaaatgtaagtttatttaagaactaacataccacagagcaaattgtcatgacacaaatgcaccaattgcccatgaagcaaagtgccccaaacctagagcagtcaatacaccttcctgaaaaggacaatctaagtagcccattttggcatggcacctgcattgatagctctgaactgcagaatgctctagtggctccttcaattagtttgtcttttactcagaatctgcttcacctggagtatgttatagttcagtcttcatgccatttttaaggggaaacaaagcaagatttaagtttcatctctaatttttccttaacaataagttcagtatttttctaagtttgaaagaatgcaatagaccaaaatacaaattaagatattatacactgaattcaaatcaaaataaaactcacggtgtgggggtttagcaataggtaggtggtttttcttttttgttttgagttggagtctaactctgtcgcccaggctggagtgcagtggcatgatctctgctcactgcagcctctgtctcccaggttcaagcaattctcctgtcagcctcacgagtagctggtattataggcacatgccactaagcccagctaatttttaaatttttagaagagacaggagtctcaacatgttggcctggctggtctcaatctcctgacctcaagtgatccacccgccttggcctcccaaagtgctgggattacaggcatgagccaccatacccagcccaatagataggttttgcatattcattttgtttaattcacttgttagttttccattaaatttaagtgaatatttgcattagtactagaacaaaggttgatgctacctgtcccaagctgagagccatatttgaatttcaatgtatattcctccagttatagtgtcattttttttctttactatggaaagaggcacaatatacacaaagacacaaatctaaaaataaaaaaaaaatctaagtacaatcctctttgacttacttactcagaatgttagaaactattttaaatagccatatgtgtaaggctgaatggtctacccattatttaaacaaaatatgtaatgatttggaaacatgtcagaagaggagtgtgagaattatgtttaaagaagaggattgcaataaaaacctatgagtaacctcatggtacctaaacaaatgaaaataagcctcctgttttattattaagccacatgaagaaacatttggtaagcattacaaaaatgaaagtgaaagtcaccattaaaaataaaattagaggtggtggctcacgcctataatctcagcactttgggaggctgaggcgggcggatcacgaggtcaggagttccagatcagcctggccaacatagtgaaacctcgtctgtactaaaaatacaataattagctgggaatgttggtgcatgcctgtggtcccagcgactcaggaagctgaggcaaggaatcgctggaaccagggaggcagaggttgccctgagccgagatcacaccactgcactccagcctgggcaacagagcaagactccatctcaagaaaaaaaaaaaaatccaattaggaaaaaagtgcactcaaggtaaagtaaaatcaatgttataattacattgtgtgattattgaataaatgaatttttatatgtctgtatgacaaaaacactgaacccagacttatacctagtaaattttagatatgagtatcaaaaatgatgatggcagattagttgtttggtctcagtttctctctctttttctgtctttcagtagtcatctcccagttccagaactcccccaggattattaactgagggaggaaaagaaagaaaatccatgatggggccagatacattagatcatagaattcattagaattaccttgtcctgtctatccattgatgctgattcttttaagcttaggtcttacatgtgcatattaaataactatgatttgttactaattattgcataaaatatgtatttctacatatcaataattaaccataggtctatgagtgccagagacccatagagctctagaaaattcaggtggcaaaaggaagatctagagaatgtgtacaaggcaaaggccagctgggatagtaaaagaataaacagactttatttttatagaagccaggaatgtagacctacctccaaggtagggaggaaggtacagtcaataaatcagactgggtcagtagtggatatggagaagagacagataagctgttcaagatgatttgaagtgaaaagataatgtatccttacaaaaggcccaggaaaccttcacctcactctcatcaggaatacgcataagagaataatgccaagacaatttctcctatattggcaaaattgagttttccacctatattatgtgtagttacttatctacatgtaagatgtgctccaattcattctaatcaccagttgtactttgggaggttgatctattacagaggttctcatcttgaaagaacatcagaattacctgaaaggcttgttagaatgcagatgactaggctccacttccagagtttctaaatcagtaggtctgaagatggcctaacaatgtgcattcctaacaaatttccttgatactgatgctgccggtcgggggaacacattttgagaagcattgatcctgtctgaattaattatttgagggccatcccaggagttgaggtaaaggtagcaagtcaaacaggaacttgctcagttaccatgagcacttcatccatgtcctttgatcccacagccatttgagaatatcttcaattcctaagtacttctgtagcccttatataccataatctcttggatcaccctgcttccccagagctgtccttccccagcaaacgccaacagtccccacagcagaaatacatttactcaggaacaggtttcttcttgacttggatcttcccacgataatttacgtgattctacaagtcttataattcacctcataaaagctactgtttcttctttcccttcatttttatccctgatgccaaatcagtttaaaacttaaatcagttttgattataaaaaataatagatctacatgatttggatatgaatcccaaagatctagagcaaattaaatgtcataatccccacctcccacctcaatggcaagcaggacacaatcccatgggttatcagtgatactattttgaaacaaattacacttattgtaaagagaagagagtttagcacagtgtatctatacctagacatgtagtgaaaactggtgacagatggtacctgttttgggtctcagattgtgacatattttaatgaacattaaattcttattcactgcctgagtcagcaaaggaattttacctcaaattctagaccagctgtcaggttttgttaattggcttaaactatcaaatgacaagacctatagaaaacatattttctctttgttcacaagcaaggtgacataacacaaattttaatcctattggaaaattattgactttcttaaaagagcatttttatggccctgaggctagccaagatttctgctcacaaaaatgttaacatagaggcacattattgttagaaatgacagttctcagttgcagttattttttccaaggaatcaactgatatgaggactactgaaatagattgaaaggcctggacctgagtctggatgtcttagtgttcattttaagtctgatactaatgttgtaggatacagatcctgtgttttttcttgatctcgattttctcttggaaacaaactgagtagatggtcctaatgaactttacatgtgtaatgagattgaagaaacactagatgagatgcaaaatctcatctagctttaacatatttggattttgtcagtttgtggcttcctaagaacaactttcttgattggtaaatctagtcaacaatatatgcaggaactttgactagatattaagatttggaatttatcatcatgtaaaataactgtactattctggcatgtggtactttccaaagatggctgtaaaatatcctcatctcagatgctttgctataacttgaccttggtgtttctccatgaggaaatgaaatctaattcccttttccttgaatctgggcaggcttgtgactttttcagcacacagaatatgactgaccatcaccattatgattgaccgtctgaagcacatgattctgtatttaactagcaatatatcttcgctcctaatcagagggcatgactgcattttgataatcagtggtcactcacttatttactgaaaggattcacattttgcctgagaagaacaatgtttgtaaggaatattctgctttaaggagatgtaatccatgcatccattcctctagatatgatagaatccctcatgaatttatcctctcctctctgtggcatgtgacagtgtgtaccacttcctacttttttgaaatctttattctcctcacttttgtgataccactttccccttgtggtatctgctcaatcttttggtcaacatcttatcctctgcctactccttgattgtagacattcctccctgaaatctattcgtttcacttaatgtgtcactctacacaatccctcagaagcattttgattgcttctgaatcaataactagtcatgaaccattttctgagattctagttgtgtaaaccaactgattaatggaaaggatttttaacttggatgtctcaaagacattttacacggaatatatccaaatctgaaataattatcatttttgtcattccagcaattcctcttctattctcctgttagggctaataaccctcctaggaacccagtcacccaaatgaaatgtctaggaaccatttcaaacttctgcctcttatcacaagtttcattcatcacatcttaacattctaatgtttctcttcttatcttaatgcccaatgctacttagttcaggtcttctgattagtcctcgtaccatcaaacatcttcctaccaaaaagaattacaaaaatgcaaatatgattcttttgcaaactctcaatggctccccatcagctgcaggccaaaactacaaatacagctgatatttttgcactcgtgttttcaaacatatacaggttacttttctgaactctattttcggcagtcacatcacttaataaagtccatattctttgagcaataatttcttatcaataataagctagcttgtaataacaagtaatacataagtgaatctattttaaattaaaagaccaatgagggttagcatttatggagcaaaaaaaatgtatgaaacaaataaatagctggtaaaatggtacgtatttaaaatgagtggaaaaatttacttaagtttagaaattattgcattattatgaagtacaatgcaataataaaggtgaaattatggaacactacttacaaccattttgttttataaaagttcatatcaaatgaacatttaatcaaatctatcaaaaattttaagaaatcataaagtagaatatgtcacgtgaaaaattaaactcatagtatcagaccggcctcttttactagaaatgataaaattcacagagtaagagaaactttagagtttttttttttttttttaaatcttggaaattcctgctgaaaccaaatgcttcaatgaagtcttttctgaaatccatttattgccaaagaaatctcattctcaaaacactcgaggtatttataatcaatgtcatttgataggctttaatttttttttgcttgaaaaactaggtgatattgtttggatctctgttctccaaatctcatgttgaaatgtgattcccagcattggaggtagggcctggtgggaggtgattggctcatgagggcggatgtctcatgaatggcttagcacaatccctttcatgatgagtcagttcccattcagttagttcacatgaaatctggttgtttaaaagagtctgggaccttcctcttatctcttttgtttccactcttgcaatgtgatatacactggctccccttctccttctgccatgattgtaagcttcctgaggcacttaccaggagcagatgctggtgtcatgcttcttgtacagcctgcagaaccatgagccagttaaacctctttatttcataagttacccagtcccagtctcaggtacccctttataataaactaaggttaaactccatcaatgtcaggataaccgtcgcttgtaactctcacatattattctgagaatcaacgtcagtctatttttttagaactatgctgcttagaactttatgaaaggctcacagacatttcttagtattactttattaattttaattgaagtcttattctggtatgctatgttttatcaagagtacaactttgaaaaacaaagttgaaaatccacctatagttttttcccactttaattcagaaaagtagcaatataacatctttgaataatctatgatccaagcaaaaataaacatttaatattcaatagcatagaagagactaaataatagtgataatatacagtactgggtttttataagaccattgaaagctagaaagtacatacggccagtttttgaagacttgataacatttcattttgatctttaaagccagttgtgtgaatcttgttcactgcatcttctttttctgaaagccatgcactaaaaaggcactgcaagacattaaagaattccaaggaataaataaacataaatctttacttttccaatttaatatccccccgtgtcttttacagctagtttctcacacatgacacacctgttcttcagtaagacgttgccatttgagaaggatgtcttgtaaaagaacccagcggtcttctgtccatctacagatgtttgcccatcgatctcccaatacctggagaagagacaatcaagcacagcatcagcaaacaattggtaactacgttttattaaaaatggcatgaataatttgccaaagtatctcagtctcctatgtacgctagaagttggaagggacactctttctgatctgcttacatttaaataagtggtgtgactgtcatttgtctttatctcaccaagtcttgtacctttcatagaaaagcaaagagacaagcaatatgaagtggttattataccactatataaaatggctccatagcaaatgtaagataacaaagacatacatatagagaggattttgcagtgagaacaagtaaaaggtgtattttccttaggtttgaaaatacaccctaaagaataaaagtctaactactaaatagaatgcctcaaaagactcttaattgaaacaatcttgcataatgagaattgcctaccatttggattgtagaagaaaattcttagtaacttaaattctattactatgtagatttttcaattttctcaattattacaaaagtattaaaattttctgtttctaaactactctagtgagaaaactaacaatctctgagtaaaaactactatatcattaacatgtcactaatgtctaagaacacacactattttaatatgtaacataaaccaactatcaatgatttttggaaggaaaacaaatattgtgatgctttctatgcaaaggaagcatttcaaaatggcagttagctcaacctcattatgatgcactttatagcctgaattttcaactttttgtaactttttcatataaataagaaacttattttctcatatatatattggacctttaaagctagaaatcataaaatattgacgtgctttattttatatagaattagagttagaaaaatgtttataactcatatttttgaaaaatctactcagtgtctaaggtctcataatttctatgttactttatactacatatgtgtattaacccacctagaggatattaacacatgatttaaacaatgcaaatgaaattagcatcatgaaaataatccacctattttttttttttttgtagacagagttttgctcctgtcacccaggctggagtgcaatggcactatctcagctcactgcaacctccacctcctggattcagggaattctcctgcctcagcctccccagtagctgagattacaggcatccaccaccatgtctggctaatttttgtatttttagtagacacggggtttcgccatcttggccaggctgctctcgaactcctgacctcaggtgatccacctgcctcagcctcccaaagtgatgggattacaggcatgagccactgcacctggccctaatccacctatttctaagtgactaggagagtcacgtttcttaaattgtttaatctatcaccacttaaaaaaaaatacacgcatgggtaaacagaaggcagtcaacattttcctacagtattaacataatcatgtacttatatgcagctcaatcataagtgagttttcagtttttcttcataaatatcaatgttattgctttcagcataatgtaactgttaattttttgtagtttcactttctactcaacttattttgaattatgtttacaataaaagccatagcgctcaaacagtgatgcgagatacccacaggaaatgtgcgagcttaaatcaatgaatttagtcacttcaaccatctaattattacgaagcagtatatataggttttttctaaaacatacttgcatttttttagctaacttcctagtgaccctgtcagtgcatgtcaggtaaaatggcacgtaacaaaatggttaatagattagttgtgggagaaaaaagcttcaaatggagaaaatcttatctcttaagtataaactacaccatctacctgacgtgatgatgcagatctacaaagtcaaaatgtgggaaatttattgtagcccatcaactccagtgaagaagacagtcaagggaagaagggacaaactcaagctatagcatcatattcataaacaaaaaagactttcaagtatatatagcatcttctctctagtgctacaagacatatagtatccactgaagcagcattttaagcttgtaaccccataggtggaaatgtataatttattaattttagtgggaatacaaatccaaataaagatcccctattccaggttgtataacattttcaaatttattgaaattctgagatgtactaatgggatgcatttaatattgcagttttgttcactgtatgagtcacaaaaaactaatagagtagttctcctttatccataggggatatgcttcaaaatcctcaggtggatgcctaaaactgcaggtagtacaaaaccctatatatagtatttatgaatttatttttctttcttcgcaatttcacggatagacttgctcttaccacagattttgagcaaccccagcatgcgatttttttcttgccttattaagttgggaaccttttcacataaagaaaacccttcacagtttttctttggcatatttgaactgccaccataactactcttgcactttggggccatgactaagtaaaactagggtgacttgaacacaagcactgcgataccatgacagtgtttctaagaacctagacaggtactgagtaatgggcgggtaacattgacagcatgaagacgctggacaaaggggtgattcagtcctgggtgagacagaggtgggatagcacaagatttcattatgctactcaaaacagcatgcaatttaaaatttatgaattgtttatttctggaatttttcatttaatattttctgactgtggttgactgccagtaattgaagccaaggagagcaaaaccatggatgagggagggagggagggagggagggagggattgctgtaattaaacactcttttaggtacataggcaacctatttaacataactatttaaaaaatgccacttaaagtgttctttatatccaaataatggagcaagtttatgattcagctaatatctaggttacagttaatgacagccatcaatgcattcattcattgatcatgaatttattatataacaaatatgtaccaaatatctggatatgccaaatattaagagaagatgttacaggctcaattgtgtcccatgaaatccatgttgaagccctatgccccacctactacatcggaatgtgcccatatttggagatagagcctataaatagaccattaagttacaatgagtctattagggttactctagtccaatatgatgggtatccttatgagaagaggaaatttggacacagcaaaacaccagggatatgtgcaacacagaggagagaccacgtgaggatacaggaacaaggcattcatctgcaatccaaggagagaggcctcacaagagaccaatccttgccagtaccttggtcttgaacttctggcccccagaatggtgagaaagtgtttgtattgtttaagccaccagtccatgttattttttaatgatagccctcacaaaggagtaatacaaaagacaattaagatagatggattctttttcaagaaatacttggctaaatgtctgtcgaataataataccaacccgttaaagaattgcaaatgttaaacaagagtatgtatgggaaagtattattaatttgaaacaagttatttaagagttggtcgttgtttacaatttgcttgatcatggttcttacatcaaatctaagaactgccaagggtcatctattttactgtattcactgtagaaaggcacccattaaatctttacgaataaatgtttagtcttcaagtatattctttaaaggtttccaacacaagacagcatgaacacatatcctttagtaacatattctattgcttaaacctatcttactcttagaaaatactcaatgaattgaatctaagtcacttctgtagcaaggcaggcatagtgctttccactgatctcagtgtaagcggaaaagtgaattagaaattacttgctcatacgctgtaaacatctgcccatacatttttgtgatgccatatgcacaagtataaatagataatacacgaagtgctttaaatttatggatttacctatttattgcttagcaatattggccttaatttgaattacaaagaatgaagcaaagcaattggaagactatatccctcagctctggaatcactcaaagatgctggttcctatcattgcctgaatggctataacaaaattgttagacaagtgtaagaaattggataaaatggggctaatacatatattttttaaagaaccactgtattaggattagaaacctcttctctagagaaaaaaaaaatatgtaacttcaactctgtttctctgagtttctatttacgtataggaatcccttgagcttttagcaataatgcatatttttatagagctaaacattctacacataaatgtaaaaccaatgaattacaaagtctcacaaaatggtaaaagaagttaatttttatttatattctcattttgtctcagcagtaagtgaagctaaaggtcagctcacttcgtctaacattttcatggactaaatcacaactccattatcgtccatgctcagatccacaacggggaggattttttcctcccatttaattcacatgtcatattgttgtacgtgccaaggacatttctcatctgaattcctttgtttggttgagttgctatttcaattcaaaagtgaaaaatggctactaaaagaacatttggataaaggtaactgaggaaaatctgacaagcctgggaggtaaatcttaagtatggtgacccttgaatttactggagccagggatagaatatgaaacctaaactgtgcccatcagtattggcgttaagagatagagtgttcccaggcgtatatccactaaggcggaaacaattatgtgccatggaccacacaatgcatcagcaacggggctttatgaaagagggaggcagaaaacaacccatcttattttattgcaggttaagaccctataatacacttctctgctaaatgaattttatgtgtaatgagccctctgaaaatcccttatttcttgatttttctcttactttatcaacaactatgcagttaaaacgtataagcaacttactcttactgatgttgaaatggaaatcacatcaaaaaccattgaaaaaaacaaaaatccattatgaggcagaaatgtggcagagtcctactgaatagtgtttagccaagggtatggcttggttctcagttttacacatttctacaaactgaactgaagcaccatactataaaatggtgtaccttatatcttcactgtataacatatggtacagggcggataaacctattttgatgagttatgaaacaactactggaagttttttcaaaagtataattcttacttctatttaaatgatcctgtaataatctcctgtctgaactcaaggaatttttagctgtcacttccaaaggggcaggttacagatgaggaaactgacagataggttaagtaacttgtctgaggtcacagaagccacagtactgagtgtctgggatttgacctcagatccatttggctacaagttcatgctcgttcataatggtattcattcagtagggcattcattataaaagatatgccttctaatttgtgctacacaacctacagtgagatatccagatgccgaatccctttggagtcttttcatattttgttttagcagaagtttgactagatttaacatttaatctaatctgcttcacaaggatgtgaagcttaatgttataatttgattcaaaaacatttgacactgtaactctgtatttgtttaatcataaaacgtcagcaaatacttgcacttccagattaagaacatgtggcctttgcaggacttatttttaaaaggtaagtatgactgatttgttcattaaattctgcctttgcaattgtgctgaaagtgtagtgagattttaacacgaagaagcatgttcttctctacgctatttcagtcagtttcctatattatttatttgtgtgagtatacaaagtgctaatgaataaatctggaaaagccttttgttgttgtcactgctgttattctttgcaggatattatttaatgtcttttttttttttttttggcagcttaataaactctgtactctccagctcccaccagtctgttcaattgggataccagaaaataaagagcaggagttctaaggagcattccagcgtaacagtgttccttccagcattcatcacattcccaggcattccttggtagcttgaggtttcctcttccttatcgttttatacctcgcagactctgagctccttgaggtgggctccttacctttgaggttaatgtcttgcacaaatatcccaaaactgaatactactactgtcgttatcaataggtggctttccccacccaacttttgtcttagaaccatcttttttggatctttcaatctgctaatcattacataaagtataaacttcctgcattcccacttcagttctactgttgcccaactttgtaatatctgtgaacaaactcaatcttgctgtgctttagttttctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaagaaaggaaaataacaggccaatcactttcatggacgtaaaggaaaaactatgaatcaaagaaaatctagcaatacacaaaaaagattatacgtcttatccaggtttagtttattacaggaagaaaggcttttttagcattagaaaactaagtcatgtgatttgacatatagcagaataaagaagaaaaatacgaccatctcaaatgattctggaaaaatatatgataaaatttggcatccggtagtgataaaacctcttagaatattaagaacagaaggtatctacaacaaacctacaggaaagatcatacttaatgattatttattaaagttcttccctctgagacttaaaatgagaaataaatatccacaatactcccattgtactagagtatttatacagtacaatatgtcagggaaaattaatgacatgaaaaataattggaaagggagaaagaaaactgtcattactcaaaaacaacctatatatgtacatctgaataatactacagataatgtattcaaattattaagtaaatgtagcatggtacctggatacaagaccaagaaaaaaaatcaactgtatttctttatatcagcacaaatagaaaatgaaatttcaaaaatatattcataacagcaaaaatataaaaacccaagaaataaatctcagagaaagtttaagagcctttactttaaaaactataaaacattattgagagaaaataaagacctaactaaatgaaaggattgaaagactttacataataaaaatgttgattctgtacaagttgatccagagaatagatgaaatccaattaaaaccacagcagattctttttgggggcagggttcacaagctgttcttaaaattcatatggagatcgaaatggccaaaagcagtcaagataatctttaaaaaggaagaaaataaaatggcttttactgaccaactgaccaaaacaaacttaatgtgactaaactctagacaggcttttatttgactataggctcctgacctctcttttcttagagcgcttactttagggaaacttgcaaccaaaaacatattctctgcctctttgagatgtaaatcttctacaatccgggaatatctttctcaaggacctaggagccatctctttgaaatgtaattgttaatgatagcacgcctatctcccagtctctgtgggacagtaggagcctaacttcattaagtgccaattaacaatcacagattgcctaatcaccatcctaaccccctaatatcttccagtatttttctactagctctcctcagtgcttaaattctctcctgtctttctttcagtagaaatgatttccatctctctctcctatggcaatagtcttgatccataattcagtagtcttgaataaagtctttcttgcctgtttgtctggtgcattttttcttttacaatattaccagatacaggctgggcctggtagctcacgcctgcaatcccaacacttcggcaggccgaggctggcagatcacctgaggtcaggagttcaagaccaacctgaccaacatggtgaaaccctgtctctactcaaaatacaaaaaaaattagccaggcatgatggtgggcacctgcaaacccagctattcaggaggttgaggcaggagaattgcttgaaccagggaggcggatgttgcattgagctgagatcttgccactgcactccagcctgggtagaaacagcgaaactccatctcaaaaaaatattaccatatattaaaacttgtcataatgctatagtaattaaaacaatgtggaattagcatgaggacaggcaagtagagaaataaaactgattagagtccataaactgatccatgcacgtataggcattttatttctaatattttcgtcaaagatgacaccacagaatattgaggaaaggatggtcttattgaaaatctttgcaataagaccatcttttcctcaatattctacagtgccaacttgttgtttcagttggatctatatgggaaaaaatggacattcatcccttcctcatacctgtaataataggtggattgtaatacgaaaggtaaaacaaacagttcctatatagcaacccaggaccatagcttcagaattttaaagtagagagttttatttttaaactgaggacaaaagtacactaaacataacagaaaatattgaagtgaactatgttaaatttaaacttctgtttatgaagagatatatcattacggagtgaaaaggcaaggtacccattcaaaaagaaaaatgtaatataaacagcaaagaatacccagaatatatatattttaaactaaaataaatcagtaagagaaatatagaaaatccagtagaaaaacaggcatttcagagaagagttcatttaaatggccaataacaactgaaatagtattccgcctcactggtcatcagtatatacaaatgaaaaatgagagatgacattataaagtcaccagaaaggctcaaattaaaaagtttaacaaacaagtattcaagaagatatgaagcagtttgtactttcatttactactggtgagaatatgaatttatacaactttggaaaaccctttgttaatatcttgaaagctaaatatgcatatacccaatgattaagaaatgctattcttaggtaaatacctaatacaaaagtttacatatatacacaaaaatatacgtacaatttatgttgatagatgaattatttgtaatgcttccgaactggaaacaaccccaattttctgaacagaatatgtaaaatgtggtatattcatacaaagtaattctatccagcgatgaaaattaataaagtaatgctatatgcaacatagtgaatctcacaaatatagtatccagtgaaaaaagccagttaaaaaactgcatatataaaagtttcatttacatcaagttaaaaatatagcaagactaacctgcagcattataactcaagatacatgttacctttgaggagatgggaagagtttatgataccatagggcttgatggaggtttcctggttgctggtaacatactatctttttctggatgtggaatcatagtatgttacttctgtaataagtctttaagctataattataacttatgtcctttgcttgatacttcaatttaaaaagtaccataaagtttgcatttttttttcagaaccatcaacagataaacagataacaggttatatatacataatgcaatgttatttggccataaaaaggaatgaaatatagctatttgcaacaacataaatggaactggaggtcattatgttaaataagcaggcacagaaagacaaataccacatgttctcattcacatgtgggagctaaaaaattggatctcatagagctagagattagaatgatagatactggagactgggaagagtgtgtggatggaatgaagagaggttgtttaatgggtacatacgcttagatagaaggaataagttctaatgttcgatagcagagtaggaagactatataattatatacaacagtgtaacaaaatatcacatgtactctataagtatgtacaaatattatgtatcaataaacttaaaaattttttgtaaatgtattaacacttgcattcataaagaatattattggccgggtggccgggcgtggtggctcacgcctgtaatcccagcactttgggaggccgaggctggcggatcacgaggtcaggagatcaagaccaacctggctaacacagtgaaacccatctctacagaaaatacaaaaaattagccaggcgtggtggcaggcgcctgcagtcccagctactcgggagtctgaggtaggagaatggcatgaacccgggaggcagagcttacagtgagccgagatcgcgccactgcactccagcctgggtgacagagcaggactccgtctcaaaaaaaaaaaaaaaaaaaaaaaaaaaaaaagaatattattgttccagcatacttgcttatatttcccctgtaattttgtatggtgggtattatgatcactgttatctttgagtttcatttgataatttttatcatgagagaatttattgttcaactcataaattataaagtcagaatagaaaacagattgagtaatccagacattgtgttctttcaaatctacctaacaccctattggccaaatgtattacaacagaccgtgtattaacataaattgaaatctagcgttaactgtatacttacagcacattggctttggatgttcaaatttcattagaatattcaacatttatttatacttgatacaatgtgcagttgaaaaaacaatgcacatatcaaagctgatcaaaacatactcaaaagttttctaataactgaatcatgtgccattttatatttaagtaaataaaataaaaaatccagttcctcaagcataccagtcacaattcaagtgctcaaaatagccaaaggtgtatagcaacttccttactgaacagtgtcgttctagaaaagaaaaaaattttatatactaatgcaatcgagtgtgacaggtgttaatatatatatactgcttatataaactatatacatatataaaccattctcttctagaacagtgttgttctagaagagaaaaatatttatgtactaatgcaattgagtgggacaggtgctaaaataaataaatatatatgtttatattatatatatttgtacttgtaaatttaactcattcatgcaaatgctatatctattcatatatatatgaatagatattgcattttatacagatagatagtatttgcatgaatgagttaaatttacaggtacgaatacattactgtgttacataggtttctgtattcccccgttgctgattagtaaaccaaaactgaaaaaaatcacataattttcacaaggccacatagcaaatttctactatgaatttgagagattgggagaaatctcaggttgagttgtcacacatctgaataccagtgtcagccttgccacctgcaagctatatgaacttggatttaacttcattatgcattggctttctcatttgtgatatagggttggcattacatacaaagcatgtaaaactcctgaaaaataataatctaataattataattattgcttcttgggcaacaaatgttgatgcttagctttgtggattatttccatcacatttaaagttttttttaaatgcatttaattcaccaaatataaaattaggaactagagcgaaacatcaaaatgtttcaaccatattcctcttcataaataacttctatttcttaatttgatagggtctaacattctataaaattttctttctcatactatcccgaagatatgtactataaaaatttcagttacctaactgacatttaggtgatgagagaaaaatctgactttatcgtctttctgaacaactacctttcacagtatagcattttctttccaagtggctttgttattttaacattctctttgtaactgagatatagcacattccctttgtaacctgtgtgatactcatgttacacaagttaaaactattaacgacactaacagcaatgtccaaagagatgttaccattaaatgtctgtcattcttattgtctacttatccagatttgtcacctttaaaaattatcactgttggtcaaaataattggcagaatgtagtatttgacttctttatattttgccattatattcagattgttttttcttatgaaagtaattttgagaatcatgctttttaaagctgaagttctctacagaatgagggagaattatgcttctactagataagattgggcagtatttccttttattttcttgcactccacctgtattggaagggacattggaggctatcaagtctaacttcccactcagtatgtcacctcttttaaaacatacttgaacatgagattccagtttgtgttaaatattattaatgaagaacagctcaccactttccacagctcttatcgcattgtaagaatgctctgggctgatgatgataataatagtaactaatattattattgcttactatatttcagtgatttttaaatgctttagcttctcaactacccttttaccctttacagatatctgataatgtaggttctaatacaatcttcatattaaagatggggaaactaaagccaaggatggttaagtgacttgcccaaaggtatactgtagataaggaacagagcaggaagggtctatttctagagtttctcctcttaattaccttacaacaaaaagctctcccttttaagtcaaaaaaatctttcttggaattatatccaaccgtctgttcataggttcattcagttatcttacaagaattactgattacttgtatctgacaatgcaggcaagaatgtgtaagacacatctcatgtaatttagattctaataaaagagtaaagcacattaatattaactgcaaaagtatatgatcggtgcccaaacagacacaattagggtacagacatggcacaaagagggagtagtcatcactaggtagagtggccaatttcatggaggaaaacttgaaatgagttttctatacatagatgaaattatcaaagcagatcttatgaagcagagtcgtctgtttaaacccggtggtatgtgcaaagaggtcgtaacatacagggtatcagaaacagcttgtatgaatcaaatgcaggttgagggacataaagcagataacatgagacaagtctatagagactggtaggagtcaggtaatcaaataccttgtaggccaaagtatcagaatctggaaagtgactcaggattttaagcaaaggagaacgattaaacaggctcttgggaacccacactgacttcaatgtggagattggatggaagagcggtaagactgaaggcaaggactttgggggcttatgatatggcctataccttgagaaatgttgacaagaacaaagatgaaataataaatacaagataaggttgagaaatattttgacattgcatgcaaagggctcataagggaaaggacagggatgaatttggggatgactctaggtttctggtacaggtgtcatgataagtgccagtgcaatgacaaaaataagaaattcagtaaggaaagcaggtttaaaggaaggcaatgtacagtgaggtaagtttcatcttgttgagtttgaagtgttgtttggacttcaaggatgtgttcagaagataattagaagaaaatggactcaggaaagatctgggcagaagacatccagagttaccaacttctgtctgcttctgatattatgacattttgaaaaaccatagagaaagtgccttcctttttcaccatcacaatagtgttcatgtgccatttccctatgattagttattttttaattaaataatcgcccactctacaaatattcttcacaggatgctgccatctgagaaaatcctgctaagatagagtaccaatcgtgggcgtaaaatacagtgtattcaaatcagcatagagtataattattagttcatgtaatctagacactatatcacagtctgtgattgcattaactaagaatctgtatcatccttaatatcaagcttgtttcaaagtaagcatgtgcactctatctcatatgtgcttatgtttatgtatatgtatgtatatacatatatatacatatgcacaaagatgtacgtatgtatatatatagaaacataaagagatgtatataaatttaactatatacacatttatacatatatttttatatagacaaaattacatgtatttttacacacttacatttatatatatttacatttatatctatagatgggaagtcagaccctttgtatctcaaactaattcaactgatttatactacttgcatttttaaaaagcagcaacatttcgaactataaacatgagttttctgacttaaaacaataggatgtaacatttgtatatgatattctaactcctcaggacatagctataaaccttctaagttaatatgggagcagaaatattccattaaccactcctacaggggcacactttacacagagccccagctaaatcctcaaatggcttccttccccagaattttcagcacgtaaatcagatactagaaaggaatatattaaaacacagactcacccacgaacactcatagagaaagatagactcaccttaccaataaacagtatcacgcagaggctttgctaaaaggttcaggaaaatcagaatacctcaaattcattccattccattggatcagccaatttaataagtctaacaaaataatttgtcttaatactaccacaaagtatttctacaaattgtttaatgtcatctgatataaagttggtttacatgactcaattttagcgaatgtagcttagttcttagaaaactatctcatctgcaaaaattattccttcaggcaataaatatgtttattaactgcatgagataagtgagaaaccataccagtgagcatggcctcatgtttaataatctgatccaaaattgtgttttccaggttttccttcttgaaaatagaatacttgttgtgacggttaatattatgtgtcaacttcatggaattgagggatgcctagatcactgatgaagtattgtttcttccgggtgtgtctgtgagagtgtagccaaagaaggctgacatgtggaccagtggactgggagaggaaggcccaccctcaatgtgggtgggcaccacccaatcagctgccagttagactagaacaaagccaggagaacagggataaagtagcttgcttggtaagtttactcactctcttcctgtgccctgcggggcagttggcttcctctcctcctgccctcggacatcagactccaggactccaggttctccagtctttggactgggggacttacaccagtgatttcccaggggctctaaggcctttggcctcacactgagagctgcactgtcagcttctctggtcttgaggcttttggacttggactgcaccaggctactaggttctctcttctcccagcttgcagatggcgtatcatgggacttcaccttgtaatcatgtgagccaattctccatgataaactcctaaatgtatattttatatacacatatatacatctatctatccatccatccatccatccagtgggttctgtccttctagagaaccttaatacactctgtctttatccattctttataattatttttattaggaaaatcaaaatacgatatgatagtcttgctatgttgcccaggctaatctttgaacttctgggctcaagcaatattctctccccagccttccaaagtgctgggattacaggtgtgagccactgtacctagcctcattcttttcatatacttttaattctccaaaatattaggcagtaacttcaatattaaagtattttaacaaaataattcaaatgccttttatatggcagaaattctcctggttctatgaccacacagaccttcaatacatctatagttggctctcaacttttaacttgtacagaataacatacctaaaaatagggttttaatggttttgctttttctttggaagacattttcattagagcatcttctataagctatgggcttaaccatgtttctccttctttctttattagaaacagttatctcccaagaacaaaaggctttctttatggtctttttatagtcttttttcatgcaagtttttataaaccacgctctcttgatttaccatttatccatcctagaaactctacccacctccaccaatctcacttatgatggcagcagcagcctgtctggagcggccactgcaaagatgccagctgcagcaagggaggcgtggccagggctgtgcactgtgtggagccaccaagggccaggaacaagcaggagcgctgctccctactgagttggcagggtgggagccccatgcttccaggtgcagctgcagccacccagccacagctccggacctgggcattcctgcgctcttgggggcctgggaagcccccctgcctccacatactaagaagtgcctgctcccactccctggcatctcctcgctccccgcactggctcctgggagaagcaaagttgcggccaagaccaggtgttgtcgcaacctgactggttatgtgtgtgctcgggacagtgctggcatgccagccccctgctgccttgcgcccgtctggactttgggcactgatgagcatgggagagaggctgagtggggactgaggatggttcggtgtgggcctgcaggtaccccttggtataaactgcctaggctacatggatggcatgttgatggtggcaggaggcagactggctcctgggcagaaaggagcagatccacagagaaacccctccttcaagccaagaatggcctgaagcctgggggctgggctgccagttctgggtggagtttgtggcccagaatgagaacttatggtgctttttctgggcctatccatggatgtccatggaccaattagaatgtacctcctcccttccgagcccataaaaaccccagactcagacaaacttagacattgggactaccagccgcaggaaggagctacctactttgtgtctccttgactcttcaggatgacctgcctgcataaaggagccacccaccatgggtctcctctctactcacagctgcacactccctgggacgacctgcctgtggaaaggagctacccaccgtggtatcctgagagctgttctctcgctcaatgaagctcctctgcaccttgctcaccctccagttgtccatgtacctcattcttcctggacatgggacaagaactcaggacttgctgaatggcaggacaaaaagagctgtaacacaaacagggctgaaacatgccccccactcaccatgctatgggcaatgagaaacagagaagagctgtggccttttgcagagcccagaccttggggctcctcaagccagggttgtggcatgctgtaacatgctccttggggctctgtggttcctggtgtctctgagctttcaggtgccaccgcgatcccctgtccagacattggtgcctgcagcagaagctacttgtggtacatctggtccagccacagcctcacatggagctgccaccagtactggtgcctgtagctgccttccgctgcagctggcatgcctgtctgtgcacagtggccaggcctcatgctcgcttgctcacatacctcttactgctctgtgcctggcttgcccttggcaggcatggggatccgggccagtagtgcaagccaagcacagcctgccaggctgagtgggtgcaaggagcccagcgggcacaagcaaaacccagacagaggtgctgccggccacagaggtttctggctggcaaagtgacacccaaggatcccatgacacttacatgcacactttatccattttcctccaatgtatgatttagatcttagcttaaagaaaactttcctcaggaatcatctgttgcgttcaaagttcagtctaagtcagagtaatttcctgtcacaaaagcttattttttgcctttataaataagttgcatccattctttaacatttgctcatttttaaaaatactttattaatgtctatttttatactggattgcatgtaccaagagcgcagttcccatgcctacctgcctatcatagtgaccatggatgacaaggaattagcattctactacaaagagggagactgagatatagtcaccattgttccagggttccaaggaaggcagtaggctctcaaattacccatcgcaaccagggtagatagtgacaaattcttttttttaactgtcttacctggttacccaacacaatccctgggacatagtaagaacataacgagtacttgttgaaaaaaattcaaatgggatgtggaatgcttagaaagagatgtggtaatgacctctaaaactgaagactatataaatgaccaattttagttataaaatttagtttataaaaatatttctcaatcaaataagttaactggcatcactgcctatgaaacagactctctacgcactgacatcctggaagcctctaaagttaaggacaagactctaatctgcagtaacattgctgagggacaagctgaacctttgagagaaagaatctaattatcggagagcacacttttcagaatattacacttcataagctatgtcatctttcagaaactctaagcatatattctgacctgtctttggttttcttcaaaccttttccaaagaagactctaaaggtattttaaagttagagaaatcctaaaatatcatcataatagaatttacagaataaatcaatacatgcagatatatcctattggaagtatttttagagttctaactcagggtgttaagtatgcatctctcttccttattggactaaatggggacttcccttcctactttcccccatctgtacctctttaccaaagacagctggctatcctttttgagcctctggatggcatttcaacagaattttagtgcaatggatgaaggaattgtggtgatgagggatgccagggcgaaggaagagaaggcgtgagatgggcactcaacactaataggttttgaggaataagttaaggatagccagactctgctctaataaaaagcctgctaagatccttctctgagtcctgatgattgtttttcttttaggggatccaaatacctgtttctctttcctgtaattcttctaattacgtctaccagaatccctctcagtccagtattaaacatattaaagtccacagtctctgaagctaccctagaattataatatacccagggtatttgtgttaaatttttttatgtttttatactttatcaatcttttaatactttatgatttctccttactcctccttctgtaccatcttctcgtcctcttcttcttgcttttaaaaagtaaactaggtaagacaagattatatcacttgcaaagaacctaagaatcatctctgtttcaaagtcaaatggaagcagagcattccacgacaattccagccaatagttaaataaagtatagaactcaagcatggattcttttgggactgaaggaactgatgggatggaatcaaagaaaagttatagcaagggctttctctccacttgattccttttaatgctgcccttttagatactagtctagattatcttaaagtcacatgacactacagagctatatagaggcaaaatgagaacatcaaaagaggaaagaagattgaagacaaaagaggaggctggaaggcagtagccattaaaggggtatgcaatcatggacaaatgcagatagagtttaagcaaattagggataatcagtacatttaccgatatttagtagatgtctttgggccaaagaaataaaggcagaaaataaggtgaaaatgaaagcaagtagaaaacaaatacagaagagtataggcccaccatacaaccatctgtgagttctacggactgtttttcaagatgccttaaccacacaagcatcaccttggatgaattatattgaaaagctattcacactgggtcagctaatgatgaaatgggtgctttcaattgttattttaaatggaaatactccatgccttagaaaaatgtctgcatttaaattttttttaaccagtaacctcccttcaacccctgcttcccagccttatttaatattaattgaaattttctggtaaagtattagattttacccatccgcagttagttactattgtatcagaattatggaattctttaaatcacagcacttcagctgattatgagtgtgtgtatattgtacacatattgtattctaagtattttaatatataaattgcattctaaatttttaaaatacttttcaagttatagttcttttaaaggacatatttagtttactaagcaaaataatctgaccttaagttgttcttccaaagcagcagttgcgtgatctccactagattcatcaactaccaccaccatgtgagtgagagaattgaccctgacttgttcttgttctagatcttcttgaagcacctgaaagataaaatgttttaaaggaaattaaaatgatattcttacatgtgtgttgaaatgatttgctctcaaatggtgaaatttatttctgctacatctcaggtactcccattttttattaacctaaaaccattccaagccaattttctgctatgacgctcagcaaaatttatatgttctattgttaatttaactggaaagtatctagagaagacaaatgttaagaaaggtacagcaggatgttctccttctcatcccaccccctttctccctttcaaggacttttttcctacaactatcagcacttctggcattttcaggctcttcttctctactgaacttctccattaccataaaaataaaacaaactcttgatccaacaaaccggtcctcctactgtcctattatgtgttcctcttcactgaaaaaaaaaaaaacaaatgtatcctatagttactgtgcctacatatttatcctactattcactttgcccactaacccattgaaatatcttttgtaaaggacaccatcaactttcatgttcctaaattcaataaccatttgttatagcgtcttacttgacatgttgattactaacctaattggccactccctcattcttgacaccttctcttgattaccctcctacctatgtgctactttttttattttttttttctattttggagacggattctcactgtgtcacccagggtggaatgccaatggcatgatctcggctcactgcaaactccacctaccgggttcaagggattctcctgcctcagcctcccgagtagctgagattacaggtgcacaccaccacgcccagctaattttttgtattttcagttgagacgggatttcaccacgttggccaggctgctctcaaactcctgacctcaggtaatctacccacctcagcctcccaaagtgctgagattacaaacgtgagccactgtgcctggcctatacactactttttagctcctttactcgttttttcccttccgctcaaactacaaatcagatgtcagtccgatttataaaaaccaatagatttctatcatactaagaaagaaaatttaacttctctacctgaaattcttatatgatctagcacctgactacctcaccagtctaattgtataccattctcgccctcacagtgtttcagaatgacttgctttgtctctcttccaaaaatgtgtcaagctgttccctctaccaggattgcttttcttccagatgtttaaatcatttctttatcattcaggactcaatgtaagtgtcacctacctagagcagcttttcatgagcaaactatccaatgttgctccctagtaattcaccatttctgtcatttttttaatcatagtattgtcactactcaataatttcttatgtatcagcttagtccttttgtctctacttactataataggcagtccactagaacagagatgccctctgtccttctcactatgtattacaagcaaataaagatcaataaacatttgtcagataaatggtaccatgtgggggtttggggaaaacatgcacagatgagtttgttccttcctgattgcacaaagattacaatataataggaagaattagtgatttttggtgtaatcacaattacactaacctcaacagaaaataaccacttggtctcaactgaaccctaggataaaaccagaataattcaaatactgcctttctaacttacaaatgtggctctgaaaaaatcatttccccctattaagtgaggctgtcacaaaacagtatttccaatctttttaaaaacatgatgtacaattattttgtaatgatgaacaggggtaaacacaggaataaattaggggtaaacaaaggaggctgctctagaaccaaggtatgttgcctgggtgctccagatcccataagaccttaccctgttacactatttattattgggatttctctgaatagctatttgagacttctaggcaactactttgtttcttagaacattttgttacataacacaagagtggagaaacaagtttgggacatttcccgttactttctggcaaacgtgctgtccctacttgcaaaacaacagtgcttagcacctatcagtctagctcttaggtattcaaactctatggcaggtggaagggaacttattaggatggctgaatcacaatctcaaatgcatgagcatttttatcctaggcttcttattttcgaagcctcaacattttagaacactataaaatcacttctttttacttcgtctctctagattttcatactacattttcaagtgaagcaatttagaataaaatgactatgcatctattttgtgtgtgcaatctatactgcctatcatgcctttgacattccagagcttataatggttaataaaactctttttgccatgaggccaaaaatggaaacattaaaattcagagttgtccttgacagtcatgttgagtctgtgttttctgagttatataagacaggactgggaacattttgaaggtgtcagccgggaatgtttcaaataataattaaaatgataatttggtggccagtgtatcataagttggttttctgaatttagtcaattcttttctgtccttcaatgagtatatataattacatatattacaaaattacaagtaaataatgccagttttcatttttacatgtaaattgctttttcacaattttaatatattttacttaagaagtgtaagaaaaacattggatccatggaatgaatccaactcttattgagtcttttaaagtctatgtgatcaaacgtactatattctccattacttagttgttctgattttgtttcgttcatctatttgttttataattggaaatggcattcttgccatattgatcaagggtttatattttatgcttggcagaagtgctaacgtaaagtaccactaaagagagttgtgagatgatagcattaaaatctaacacaagaaccctctggacttacggtgagtacaaggaaataaaggagtggggaaaggctctctacagtgactaagaacgttgaagagtccagagtgctggagtagatttgcataaggtacatttgatttaatgttatttccagtatctcttctcctctatgactttttaaaattgtatttcttctttctcagctaattaggaattaaactaaaaaaggttaaactgacttttttgagcacactaaatagctgtaagacaaaagctatggtaaaacagtaagcacgtctcctattttctcagacttcaaatgcgaaataaatattagtgaatataactgtattagctaatctccttaatatcagcaaaatacagattatgaactatgcaacgttcagggtttacttttacactgattcttacaagtagcagaaacgccagacataaaaagctggagttaaaaagttcaattgttctgccaaactaggaatccatgaataaaggccttgatcattggggtaaagaatgcctgcctgtttctccagttggaaagaaatgaattctcaagagtatttaaaaaaaataatatgctaaagtgttgtaaggctatatttaattacaattttaaatactgacttcttatggatttcaatttgtcatagatgaatttatacaacggagatttatattggatttgctaattaagcctgaaatatgagccaaatagtttccaaatatagatgcatccctagagaagtacacaaaaatgtttgtctgtcagaaaataataccttcaaattaaaatattgtaatataatattgttaaaatgttttcctttattaaaagcttccagattgtacatacacatacacatatatacacacatactaggtactttattatgcatttattttcattattttattaaaggaatgcttttgtaacacttaccagatttcaaacatctatcatgttcctagttaaatttcattaccattattagatacaaatgttaccaatgtttgttgtcaaatgtcaaataatgtatttttttctttatgacaagagaaaaggccaacagtgagatgtaacattaagaatgcctagattggacaaacagtttttgttatacctctgtgaataattgtatttcttctaaataagtctctagttaaagggcttaacaaaatttgttactcccttagtacatgttcccaattttattatttaaacctgacttttcttgtacttcttttaaatgccatcagtgatactgaattcttctggctcttgtccatgtcaagttggttttcaaaagtggcttagaaaaaccactggagagccacttcagtgtttattctagatctatgctattttaccctttcttagaacacatgtaaaataatacttaggaaataaagacatggaattatgtaaggctagggaaatttttgatttgatgtttaaaggtgaagagcaataattaatcgaaaggcagtataatagaaaacaaaaacaaggatgggtatcctgtaaattcgatgggagaagcttttgttttacttgtctatttcttttggccatagcatagactcagctatggaaagaacaggaaaagaacagctgttacctatatgtaaagttttttttttttttaactactcctccgacttcattgaatacccaacagctaattgccggtacttgcaggtcacacacacacaaacacgcacacgcacacacacacacacacacacacacaaaacacacccctagaaacaacacagaacgctgttcatcatgaattggaaggcaatctattgtctccaaaaatgactttaaaattaatatatttagatgtttaattacaaatattcagtagtttgtagtttatctcaataaatgcacacataaggaaagactaacgagaaaaaaattgtagcaaacataaaatttgcaaaggacattaagaattcagaaggttctaggaatagagttgagtctaacatccaggaaagaagtatcttaaaaaagctgtctcatgaacaaaaaaatccctagatactaatgatcatgttaattcaagacatctggacaggaattgactttttttcaaataaaaacttcaagtacagatcagaaagtgttaggatttcttgggaaatgatggggtggtaggtaatttatttttttcactcttttcctctatgccccattccttctaccacctctacactgggctaggctctatatcccttgctggcctgaatgatatgatctggaaaggactttcgattttatttgcagtgaaatattcactttgctaagcctggctggtcacagtattgtctagctttccatgaagatctatttacggtatataactttgttataaatttgctgaatattttaaataatcttcctcaacaggctaccctagaaaagcttttgatattcacttacttaaatgtgattgaatatctttattagttcttatatcagaacacactgattttatctttttgttagaaatgaatgtttatgtttctgccaactcctaagctaccaaatgggggttctgaaagactgtttcaatggagagatttgaaaggctatacaagcacactaaatgcttctcaatagcctgaaggggactcaataaatacgaaaagaaactgttttaaaaataaagtagacaattaatgtactcctacatatggaaaaggacataggatgaaatagattgaccaaaacttgtgcatgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgctctagtctctaggatctcaggtggagtcaagcttcactggaatctcaaaatggagagaaatggtctcaaaggcagacaggtcaaagttaaaatcagaatctaccaattaatactgaagttaccttgaacaactccttaaactctttgaacacatctatttgtctgtaaaatcaagtattaatatccttccaggccagacacttacagaacattctattctaccaccacagaatgtacattattctcatctgcacgtggatcattatcaaaaattgaaaatgtgctaggccacaaggtggttcttaacacatttttaaaaaaatcaaaatcatatcaagcatcttcttgcaccacagtggaaaaaaactagaaatgagtaccaagaagactccttaaatctatacaaatacatggaaattaaacaacctgctcctgaatgatctttggacaatgaaatcaaggaagaaattaaaactttttgaaacaaataaaaagagacatacaacatacctccacctctgggatacagcaaaagcagtcctaagatggaaatttatagcattaactgcctacaccaaaaagatagaaagatctaaaattagcaaactaatattgtacttcaatgaactagaaaaccaagaacaaaccgaaaccaaagctagcagaatataagaaataacaatgatcagagcagaactaaatgaaactgagataataaaagacaaaaaattaaaaaaattagagagttttctttgaaaagataaacaaaattaataggccactagctagattaaccaagaaaaaaacagaagaatcaaataagcaaagtcagagatgatagatgtgacgttacaactgataccatagaaatacgaaagattatcagactactatgggcatctctaggtacacaaattagaaaatctggaggaaatgaataaattcctggatacatatcaactcccaaaattgaaccacaagaagcaaaaatcttggacagaccaataacaaatagtgaaactgaatcagtaataaatatctcccaataaaataaagctcaggaccagacgtattcacagccgaattctaccagacatgcaaagaactggtaccaatcctattgtaactgttgcaaaatatcaaacaagaggaaattctccctaattaattctacgaagccagtatcaccatgataccaaaggcaggtaaggacacaacaaaaaggaaaccacaggccaatatccctgatgaacatagatgcaaaaatcctcaacagaatgctagcaaaccaaacccaaaagcataacaaaaagataatacatgacaataacgtgagctttatgccaggtaggcagggatatatgcagagcaatatctgtgattcaccacataacacaatatatgttttgtgtggtgcaatatatgcagagcaatatatgtgattcaccacataaaaagaattaaaaacaaaaaacatatgatcatctcaatagatgcagaaaaggcatttgataaaatccagcctctccccaagataaagaccctcaacaactaggcattgaaagaacatatctcaaaataacaaaagtcatatatgacaaaccaagagccaacatcatactaaacaggaacatgttgagagcacccccctcccccaagaactacaacaagacaaggatacccattttcactgctccaattcaacatagtactggaagtcctagctagagcaatcaggcaagagaaagaaataaaaggcatccaaattgggaaaaagaaagtcaaatgatttctcttcactgatgataggattttacatctagaaaacccttaagactcctccaaaaggaccctatatttgataaatgacttcagtaaagtttcaggatatgaaatcaatgtacaaaattggtagcatttctatacaccaataatgatcaagctgagaaccaaatcaagaactcaatctcatttacaacaactacaaaaaaaaaaaatacctaggaatgcctttaaacaaaaaagtgaaaggtgtctacaaggagaactacaaaacacccatgaaataaatcatagatgacacaaacaaatggaaaaactttccctgctcatggattgggagcatcaatattgttaaaataaccacactgctcaaagcaatttacagattgaacacagtccttataaattaccaacatcatttttcacagaattagaaaaagatagtaaaatacatagagaatcaaaaaagagcccaaatagtcaaagcaatgctaagcaagaagaataaagttgaaggcatcacattacctgacttcaaattatactaaaaggctacagtaaccaaaacagtatggtactggtataaaaacagatacatatagattgatttaaccaaattaagaacccagatataaaaccacatatctatgaccaacacatctttaacaaagtaaaaaaatgtatatatacactggggaaaggacatcctattcagtaaattgtgctgtaaatattggatagtcataagcagaagaatgaaactgggtcataaatcaccatatacaaaaattaactcaaaatgtattaaagacttaaatgtaagacctgaaaatataaaaatcctaaaagaaaacctaggaaaaactcttctcgacactggcttgggcaaagaatttatgactaagtactcaaaaacaaaagtagacaaatggaacttaattttaaaatcttctgaacagcaaaaacaaacaaacaaaaaaacaaaaaacaatcaacagaatgaacagacaacttatagaatggaaaacaattccgaactatacatctaacaaaaaactaatatctagaatctaaaagtaactcaacaagaagaaaaatagataaccccattaaaaagtaggcaaaggacattagcagacattttttaaaagaagatatacaagtggccaacaaacatatgagaaaatgctcaacatcactaatcatcagagaaatgcaaattaaaaccacaaggagatatgatctcacaccaatcagtatggctattatttgtttttttcaatgtcatttaaaaatttgtgggtacagagtaggtgtatttgtggggtacatgagatgttttgatacaggcatgcaaagtgaaataatcacatcatggagaatttagtatctatcaccttaagcatttgtcctttgtcttacaagcaacctaattatatgctttcacagttattgtaaaatgtacaagttattattgaccatagttactgtatgatatgatcaaatattatgtcttttcattctttctaactgtaatttttgtacccaataaccatccccacctcccttccaccacccttcccagtctctgataaccatccttctactctctatttccatgacttcaattgttttaatttttagatcccacaaataagtcagaacataagagatgtttgtctttctgtgcctggcttatttcacttaacataacgatctctagttccatccacattgttccaaatgacagtatctcatttttttaaggggatacctgtcattaaaaaagtcaaacaacaacaggtgttggcaaggatgtggagaaaagaaaatgtttattcactcttggtgggaatgtaagttaatataaacattatgtaaaacagtatggagatttctcaaagaacttaaaacacaactattggatcctgcaatcctagtactgggtatatactcaacaaaaacaacaaaaagtgttacatgaaaaagctacctgcagttgtatgtttatcatagcactatttacaatagcaaagaatcaacctaagcgtccatcagtaaatgattggataaagaaaatgtgatatgcacatgtatatatgtgtgtatatacgcatatatatatatatatatatacacacacacatacatatatatacacacatatatacacacacaccacagaacactacacagcctaagaaagtatgaaatcctgtcttttgcagttacatgaataggaactataggccattatcctaagtgaagtaacttggaaacagaaacctaaatgcaacatgttctcgcttataagaagaaactaaacaaagggtacacacggacatctagagtggaataatataaactggaaactacaaaagattataggctggtaggggggtgaggggtgaaaaattacctattgagtatagtgttcgctattcagattatggatatactaaaatcccagactccaccactacacgatatatccatgtaacaaacctgcacatgcaccccctcaatctattttaaaacttcttctaagacatgcttattactagagttaaatgagacaatacattaacttcagcttgtacagtgcttagatttggtaggtggtgaggaaatgcttattttctttcatttctgacgtattcacattatccttgcattcttacactgagattcatggaaatagcccttttgagcatcactatttatttctaataacttggtaatcacattatatttccattattaaatatcctcagtgtgccaaaactgtagaccattatgtaaaaatagtttagtgcttttttagtcttactagatatgacttagataaaaatttaattgttaaaggatacagtatcattacttccaatgaataagagagtactaccagatgtaccagtagaaatctactagtattagaaatccactagaaattctgttcataacagaaatattaaacaggatagttctccatattcttcagaaaaagtatcatattcaaccttatattttaacacgggattggatttacggacatgcattttgttataagatacggtcatacatttgataaggaaaattattgccttaaaattcatgttatcatgtgtgtcttagctttcttgtaaggtttccctaaaatgcattttaaaatgttttttataattagtttatctacattattaattttgtattacctatacgaaagaactgaaattgattgttacagtactggttcagagagagagagacattttacatgagactaactcagtaaattagaaatagggtacttatttttttcctttaaacaccattggagaggtcagtgtcttctcatgaggaagtattacaagagtaatgaagtataataactaatgttagtgcctctaagatgacagagtcttgatcaggtataattttcgtagctataccgatatactgtcaaacaaagctgtgacattctaagtaatgttactgaatcaatactcagtaatttctaataaagtaaataataatctgatagctagaaatacttgatttgtaaaataagaatatgggcatggattttatattattattattttaataatctatagcattactgtgcaaatatacccttggaatatgatgcttgttaatagaattcttatgggatattagatgtcttctcaattcgattttaaaaattgtaactgaatatcatgcacatactactacgtagactataaaagtgtgatgttcttttttacataaacttccaatcatttatgtcaaaataatactaccactcaaaccaatttcatagtcaatggtttagcactattaagatatttgcatatgggaatgcaacagagatagaaggaaaaaaggaaagtcagagattgaagacaccagagataacatcaccaggtaagccactttacagatgtatttttctacagctttatgaatttttttttgctgtatgcccaacgttttaattgaaattatcaaactttcatgcccttgtcagaaagttagccatgatggagacgatttggataataaaactagtcaatataatcagaacatgtgttctaaaaacatttactgagcatcaattattgactaagcactctgaaaacacaaaagaaatctggctctctggttataatacagtattttttcagattatagtgtttatcccccttaccatcataaccattaaactttcattaagcacttatgagggcaaaagacaggaaataaaatgaaacttcatagcagaaacaaacaacatgtaattttaaccttgctaaatatgagagtgagtttgctaaccactaaaagcaccacttgatcctatggcactgtcaaacttaactgaatcacttatccttcttccaactattgcatttctctttttcactgcctattttcttaattaccaatctcaagtcccaattgcccagtcccagaatctattactttgagctttttgttcatatcctaaatctagtcctattggttttgatttgatatccagaatgctttgtacctgtttacaatttttgttgtcattgctttcattcaggctctatatactttcagcaatatcctcttaacatgttttccggcctcctgtttctctgctcttttatttatcctcaaaaaatatcttcttaaatattaagataagttttcctaaattgctgctatttctagtttaatttctcatgaataatggtttcctgttactcatagaactactactgcaaatgcctgagtcttttatataagactcatgatcaccctccatgatcaggcttaaatcctccagcattcagtatagtacaagacatcgtaaatgattggtttctgcattcttcacagcacccatgtgctataatgagggtttgttcagtgatatggaatagaatgcaatggaatgaaatgaaatgtcagatcctttggcagaattatacctaatccttctctgtaacatgaacatctagatcattttaaaggtcaccagatgaggatatttcacaatcttggcaacccaaatgtctgcctttaactaaccttcaagaaaaggataggtgactgagtttctaagaggctacttagtttgtattaatcagtatttcacatataaccttcactgaagtcagaatatagagtatatattcacatcggcaaattcttgtaatttgtaaagtctttgttgatgctgtcaccaaggttatgcatctatgcacaaaagtctaaatctctcaaaagaatggaaaacctagctagtaaactcagctttaaacttcatcgcagtctcactgtgccaggagacaaaagatttcactgttaaatattttccttttgaaaaaaatgcctccaaaatggcaaacttctttactattaatgaaagctcaaggcttttcctcctcaatagcatcatgccactccttcgagggaaatcctttcattctttgtcaacatcactaataaattctaccccttaagacaaaaaagaccagctagaattatatgtgatatattttttcacaggggaatgagaggttcgatttgtttactccccagaaagactcactcttgggtgcctcaaagctaaagcaaacctctaaattctctccctacagcaatgtctatgaaggatgagtggtttctcccaaatggtgcagccaattgaacttttcttggttacccagagtaaagagtttggctagatttaatagtaaccaccatataggatcaattgctttaccttacctaattgccaggttcagtaaaagtgacttatcttcctgacatttcacagtgtctgaatttctagcctgcctcataataaaatgctgttgaaatgaagatagcaaaggatcctgtcacagaatatacagaagcatatctgtaatattcacagtgtacttgcaagatttgcaaacattttaatcttgccctccagttgagagagagagagcaggcgacctctgatctgagcagaatttaaatcaattcccagcaataaaatctgtatcttttctttaattttgtcatctgcaatcatctttaagaaaaaatggtgatggcacaaggatttaatgtctatctacacaaagctaaaaataaatattatattaggttagaagtttggtgatgcagcagatgggagttgcttttgtggggactctaaggttactgatgcattttgttgtcagaaggagaaatttccttactttcaatgatttacaattcttgggaaaaaaagctgcaaagcgattcaacgactatataaataaggctttagtttgaactcagttacccaaagaagtaacatttattttcttttgttttatgaagtgtggcaagactaacaaaacagtgttcctttaattctgtatgtatgctccttttagtcttaaaagacaatataatgtacatgtttcaggtttaaataaagtcaactctttgctaaattgtttgatgttaagtcaccttcttctcgccaaaattgttgccaagaaacaaaagagcattatcaatattcaggacttgaatatgaatctttcccttaatttttataaaaaaaaaatctgtcaaatatttcaaaaaatattgtcaaatctgtcaaaaaaaagagtgctcaaatagttaaaagtaggagttggccttactctctgagccagaaaaccaatgccttctggcctctttatgccctttaaataaataaataatgcctggaggtaaaatgttacataatcaacttgcatatactcctgttgccttcttttgtttcacattttttcttcaaggcaatttcatagtcattagaaatggcatactttcaagtaatgaataatatatttaaattttatgacaatatttgtcaaacgttttccatttcattcacattatatctttcagaaaaaactacaaaacatttcaggtacctggcagaatattaagatcctggatagcttgtctcaccttaatgaagagtctgttcagcgtcccaagctaagaacttccttcatagctgccctaggttatccgtacttagctatgctaacattcttcttctactgctcttttggagctcttctccctggatttcgctttacactccaggcatccagcagcagtgtcctgccttctgatgttcagtgttacgtggcctaatcttggccttttctaaaatacttcaacttccaaaagtattggacacatttaaactgtgactggaaggaacactagaaacaaactcactcttttatttccaaagtaaagatacagagaacctgggacattaagtgatgtttggaaaatgacaatttagttagtggtagaactggagctcgaattctggcttctagtgggagaagtttgtcttgggttagattcctccaaaaacacatcctgaacaaaagatttgtgaacaaataaatggtttatttggagggtgaactcgtaaggcattatgagagcacggggacgttcaggaagttaccctgtggatacctggagctcagtcttactggggaatctctgaaagactgtggagaatataccttagaaatgtcccactatgggacaaagattctacaggatttctctatcaacttttactcctcattggctaagggcagctctggtggcactaattccacttcctgtccaccttcaaactggctgaaatggttctgcaccagaaataccctccggtagagagaagccattgctgtacatcaaccttgtccaatccatgacccaggatggctttcaatgtggcccaacacaaatttgtaaactttcttaaaatattttttcaattatttcttttagttcaccagctatcattagtgttagtatattttatgtgtggcccaagacaattcttccaatgtcgcccagggaagccaacgggttggacacccctggtttatatagacactttctgcatgtaacttccagtgtaggccaagggaaagagggcagatatagtgtcaacgagagaagcaaatgtgccacatcggaaaagcggtacggttagagaactagcactgtacctaacttcttcttcaggtgctcaattagtatctatatgacaagtaatcacagttacaatttctacataattgcaatacagttgatgtttttttcctgatggcatagcagacggggattaccatagttacagttcttcttaaatgctagatcttagaggactcctgggggtcaataatagtaagggctggccccatttgtcattcaaaactgaagctcattaaacttaaaaaaaactctagaacttagaaataaatgtatctttcatttgcatggaagaactgtaaagctatatatgactgaatattataaaaagagagaattaagtttgacaaaaggcagatttcgaaggtatgaggtaaaggagcagatattcctattcaaagccataaatccaaaaaccacagatcataagtagagttgccagataaaataaaagacactcagcaaaatgtgaatttcagataaacaatgaacaatttgggacacacactaagaaaattatttgttgtttatctgaaatttacatttaagtaggcttcttttatttgtgtctgctaaatgtggcaaccctaatcctgggacaattacaaaggatcttgtgtgtgtgtgtgtttcctcatgaattgagcaggagcctatttcaacaataaaactcagagctaattgtaatattttatggcacttattaaaataaagcaccctcataattttggataagaaatattattgtagaagtctcaataacagaaacaaaaaaaaatgctttctggcagcgagggagcataactggaaatgtacaagtaaactgaagaaaaaagatggaaatattaacatttaaaaaatgtcatattctatagaaaagcaatgcttcagactctcatttatcatcaagcttggccagcttcaatttactataaattgaatgtaaaattacattaaaaaaaatcgtagccttattatttaaatttgcattacaagtaatccctatgaagtctgtcttccaggaaagcaaatttttaataaatcacataccctgcgttgttctcatccacaaatatgtttgatttcttttccaaatacgaaaagcctagctatgctgtattttttaaaaaaacaacaacaaatgtcttaatccattttgtgctgctgtaacaaaaataactgagaatgaggtaatttaggaagaatgtacctttattttttcacagttctcgagtttgggaaatccaagatcaagatgttagcatctggtgagggccttttcacagagttttcacatggtggtgcatggtggagggtcaagagataggagaacactgtgtgaagcctcttttatatgggacttgatcctattcttaagggaggagccctgatggattattcacccttaaatattccatctcctaatacaatcacctgaattttggaggggacttattcaagccattgcaacaaagattgcaaaaacaattaggtaaaaataatttttaaaatatggctgactttaagttttaattctctcccatcaaccatgtcatctgtgttactgtgtataggtactatacacagagtttgctttctagtagaaagcacgcaacataagatacacctaccttatgttgttgtacttggcgttttaggtcttcaagatcaggtccaagaggctcttcctccattttccttgttctttcttctgtttttgttagccagtcattcaactctttcagtttctgattctggagatccattaaaactctatgtaaactgaaaatttgaaagaagcctattatgacctctttgaaagcaacttattactgaacatcacaatgtaaaacaatagaatttataatatatggaatgttcgcatttgggggcatctattggacattgagaaggatgtaagtaaagcccactatcagtcaccccggaactattatttctcagacttataatagttcacaaatcctgatttctaaaaactttcacatagtcaactaaatgtgaacatgctaactgaagtgcaaagcatctgataattgactaagtagtatattttggcagttgttcgtttacattctcattatttagtatgtgtggtggttaaagatggccacaaattctttgtcacttttcccttcaagagatgaggtctattttccatccctgtgaatatgatctggacttgtgtttttttttttgaccacagaatgtggcataactgacaccacaccaattccaagtgtaggctataaaagaactggcagcatttgtatttcttcctctcttgaagcctagattccatgctgtaaaggaggccaggctacactaccgaatcattagagaccatataggagtgattctgcaggataaaatactgtattagaagtgagcttccagctcagcacagcccaaggggtgacccccagctataaaactagtaatataaaaacaacctggctgagccctgcttatattctcggtcttcagatcatgacgcaattataaattgttttaacccattaagtttggacgtcatttgatacacacaaatagactagagaaagggtgctttttccccacaaagatatagaaaatagtgggctgggtaatgaatttaaagtccaaaggcctaggttcacagcccagcggtaagctctacaaccaggttcttaaacgttctcaattacatttccagcatcagggacatgggataatgttttgcctattaattacacaactttatgttgaggatgaaaacacattattgttcattcattaattcaaccaaaatttgagatgcaaatgagaagtgctgatggttattttaaaggaaatactctttataaacatcatgtttaaagcatttttcaaaactatattctgaacattgatcttataatttgaattaggaatatgttattttgaatacataattttactctaaaatctttactggaagtttccattaatcatcacatttaaacacacaaagtgcacacatagctgagagtgttttttaacagatttaattttttggctgttttagattcacgaaaaattaatgagattataatacaaagagttatcatataacttgcactcagtctcccgttttattaacatcttatgttattatggaacatctcttacaattaatgaaccaatatttgtgcattagctggagactattattatattctgatttccttaaactattttttgtatttcagtatctctccaaggattccatattacactcaattgtcctgtttccttaatctgcttttggctatgacagtttctcagaatttttctggcagtttttaaaagtgctggccaggctggtattttgtagtatgcctctcagtggggatttgtctgattttttttcctcataattaaactggggtttttgaaagaccacagaagtaatgggccattttaagcacattttataaagcatatataccctcaacgtgacttatcaatgttaaatgtgaccacctggctaaagtaataggtgtcatgtttatccactataaagttactctttccccctcttttcacactgttttttaataagaaagtcactatacacagcccctgtggagtggggagttacattccctctccgtgagggcagagaagttacataagtttttggagttttttctgcattggagatttgtctctattcctccatttatttatgaaattatttatttacatagcatggactcatgtatagttatttgatactttgggctaaatccaatactagtttttgctttggatttttgctcaaatagttccagctttggacattgggaagtctcttagttggcttctttgacacatcccatcagtgttttttgtttagagcgagaccgtggagtttagcatgttcttactatctggcactaccaaatgttccaggctcattttctatattccctttcctagtgttagaatcagctgtttctccacagtgttctggttcctttttttttttttttttttttttttctttaaagaatgttactgaaacccaagatcctgttgctaggtatgctccttgcttctagggtgttgtagcttacaggacctctgggttgacataaagaagtggatgtgtgagtgtgtactcacccataaatacttctatatataattatctcatctgtattaacctaatattaatttatccatctctctccaccttgtgacttctgttccttatctgtgaactacctcttcaacttttttttgaactacctcttcaacattttgagttataagaaactcaaaaatgatttctttaaactagaagttgagatgaccgctgttcatgtttggctcctcatgctgctgaatccacagacagagaaaggggttaccatacagaacctaagcacaaatggtcaactgagttcacccaatacaatgcggggcaagtagtactacattagaaaactatgggcatttgccaggagtctcttagtatacccatatatgatagtgttaaccaataaaaaaaacagaagatactcgatcaatatggaaacactaataatatggttctttggaaggatgttttttatttcccactaaggtcaaagtacgcaactagaagaaattctgccatagtaaccaagacagcattgtattagcataaaaactgatcagtggaacataatagagaacccaggaataaattaatgcatttgcattcaactgattttggacatgggtgtcaagaacacaccgtgaggacaggacaccctcttcagcaaatgctaccaggaaaagtaagaatctacatgcagaagaatgaaattagacccttatcccttgccacatacaaaaaccaatttgaaatggattaaaaacttaaatttaagactcaaaactctcaatctattagtagaaaacatagaggacaagcttcatcacaattatttgggcaataacttttgaatatgactgtaaaagcacaagcaacaaaagcaaaaatagactgaggacttataccaaactaaaaatttctgcacagcaaaaaaattaaaattaaaattaaaaattaacagagtaaagagatatccaatagaatgagaaaaatatttgcaaactatatatctgatgggggttcatataaaaatatggaagaaattcaaccaactccatagcaagaaaacaaataacctgattaaaaataggcaaaagaccaaaatagacatttatcataaaagggacaaatggataacacagatatgaaaaaatgctcaacagcactaatcatctgggaaatgcaaattaaaaccacaatgaggtatcagcttacttgcaaagaaaagggaacacttatacactgtttgtgggagtgtaaattatttcaactattgttgaaaacagtgtggtgattccacaaagacctcaaaacagaactaccattggacccagcaatcctattattgtgtatacacttaaaggaatataaatcattctaccaaaaagacacatgcacacatatgttcgtggcagcactattcacaatcacaaagacaatcaacctaaatgcttatcagtggtaaactggataaagaaaatgtggtaaacacataccatggaatactatgcggccatgaaaaagagtaagattatgttctttgcagaaacgtagatgaagctggaggccattatccttagcaaaataacgcagaaacagaaaaccaaatacaccacgttctcacttataagtgggagctaaatgatgagaacacatgggcacatagagggaaacaacagacatggggcctattggagtttggagggtggcagaaggaaagaattaggaaaaaataactaatgagtactaagcttatacctggtgatgaaataatctgtacaataaacttccatgacacaagtttacccatgtaacaaaactgcacatgtacccttgcacctaaaagttaaaatataatagtaattaacgatatctttgtcaaaagaaaaaagaagagattatcacctcacttttgttagcatggctactatccaaaacaaaaaaagataaatgttgataacgatttaggaaaaaggcatgtattacgtacctgcaaaagttaaaaattactaattaaaaaaaagaaaacctttacacactgtaaatgggaatggcaatcagtacaggcatcatggaaaacagtatgaaggctccttgaaatatgaacaacaaaactacaatatgatacaaaatcccactatgaattatatatacaaaggaaatgaaatcagtatgtcaaagaaatatctgcactaccatttttattgcagcactattcatggccaagatatggaatcaatccaaatatccaccaacatatgaacggataaagaaaatgtggtatacatatatacaatggaatactattcagccataaaaaagaataaaatactgtcatttgcaacaacatggatgaacctggaggatattatgttaagtgaaataagccagtaaagaaagaaaaccactgcctaatttcacttatatgtggaatctaaaagagctgatcccacagaagtagggaatgaatagtggttaccagaggctgaggtggttatggggaagggggaggtatggagatacttttcaagggatatatagtcacagtcaaaatattcaagtgatgtattttacagcatggtgactacagctaatgaaaatatactcttgaaaaatgtagagagagaggacgttaaatattcccaccataaaaatgataaatatgtaaggtaatgcatatgttaattagctagattcaactgttccacaatatatatttactcagaagcatcacgttgtacatgatgaatatacaattttatctgtcaatttaaagtagggtttaaaaagcaatgtttagaaattgatagcatttcaaacaataaaatataaaagttgggtctgttgagtgtgtgtgtggatgctgcatactattggcaggaaagatagaacacactcaaatatgtttcgctcagtagactacttacacatttatgtgaagggtcgggggaaaaataataaacgatagtgaaggagccaggacctaacaacaaagacaactgacctagcatccccggaactggaagaaaaaaggaagagagctgttgccggagctcagtgagaattagagacatggaacaagagctgtccaacagtagctgtagtttaagaggaacacaattccagccactccacagtaagaaacagaagaggaagagaaaagtaccacaatctctgctttcaccctcttgccagtgcctcccattggctgaagtactttagcaaccaaaggccaagaggaacctgggtaacagaaaatctagacttcatcctctttgaacagagcaagaaggagaaaagtgaaatgaatctgctaaacagagtaactatcaaaatacttaaattagtataagtgtatttaaaacaaaaggatacaaaattccatcagcatctttatcctcatacactaatgccaggctatttaaaccccaacatggaacctgtatgtaatgttacataccactcacactcttcatataaaattacagggaaacaggggaagtaaaccagtaaaataaaatataaaagataatggctccatagctggtccgaagtattggggttgttatcagagctttcttccaatatgcatttcatattccttttgagagtgtttacaataatttagattgcactatttattgacttttaacattttagagacacatttaccatgaggaacattgcaatcagaagttatgagaataaactttcatttatcaaacacaaaaagtagacattttatttttatgagaaacaacagagatgagatatccatttaagtggaagcaaaaactgaaagttgctagtatttgaaagcatcatttactttttgcttttggacagacatttccttcaacaaatctttactgagtttcatatctatgcaggaaactcatatttgttaggaatggacaaaatacctatcttcaatttcaagtagcttagagactattagagacataaatacaaaaataattagaatataagaaatccattataattagatttatatacattcctgagggagtaaggagaggatacaaattgacctgcagtcattgggaacagtgtcctcgcagaacacacagcctaagagttgagacttgaaaaattcattcattaatttacgaaatatacaattattgagtacctggatactacggatggagaggcaaggaagaccaacacagccccttgctatcttggagtttatatggatggcgggtgagggccacagataatacatatagctcaacaggccattagttggttataatgtgatcatactatgaaatgagagcaattgaattgagtctgtaaaggggggcctttagtgcagtactggacaactgtgaagactgaagtcagaagtagtgaaaaagaaggtataaactctttctagacggaaagaaagacctgtgaaaggccctgtcacatcacagaggaaccggaaatccagtgcagcttgatcgcacaaggtgcaggatggttgtacagtatcatagcctaccttaatctgtgggtccacagagatttcttgagctctgccccaaatctgaaatttgaacacccagtaatctttcatgttctatcgtggtttcattttacaaacttggactcagagattgaccaataagaagagatgtacacataagtgttttatcttctttttttttttttctcttaatagagacaaggtctcattatgttgcccaggctggtcttcaactccttagctcaagcaatcctctccccttggcctcccaaaagtgctgggattataggcgcgagtccccgaacccagccaggtgttttctctttataagtgggatacagaaacatctggttggggatttttggggtagggaccagaatggctgggtgtgtgcaaacgggatggctcaatattttaatgactggtacagtcacatcaatgtctcccagccaaatagagccctgctttttctctcttcattagtggttctgaaagtgtggttactggaccctggaccaacagcatcagcccatcccctagaaacttgctagaagtgcaaattcaaaacttgctagaagtgtgtgcaagactcacacttactgaatcagaaactctgggatgaggtctagaaatgtgtattttaacaggacttccaggtgactgatgcatactcacacttgaaaattactgctctaggtaactttattctacaaacacaactcacccaaattctgcagagaccaagatattaacattaataggaggacaactgccaatccccaggagattactatgaattattttgacatgagacttttacattctcttcctgacttcacctccacttacagagagaagtgtgactgccaactgccaaagaatgggttctacctgaggctccaaaaagcaggatttcatgtgtctgaagcatgaaattaacctcagaacaagtttgaaaacagaagaacctaaggattgtggaggtgtgatactaataagcacgaaaacaaaaagcattcatcccattgttggaaaggattctgagatgttttaattgagaaaatatttcttttccttactacaggccttgactagatattagcaaatagtagtccatatgctggatttggtctcatactaattgaaaataaattgaaatttttgccagtagttaaaatttgagatattagctacaaatatcaaatctgaccactcttgatcatatttaataggattcagcaaccctaaaccttccttcctataggacaaaattgagtatcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagactcagaatgcccaagtatgcccttcagtaaagtaaggaagggctttattacagtactgatatgtgaaaaactctaaagattgaaataactagtaatgaagaggacgcttccttccttcactgaggcctgtgaaaagagcatcagtaaagtgcaggtgaattataggccagagttttctgggtgattagcaaggaagtgagtagtggtccattgcaaggctgaaccagaggaagaagcaaaattgaaggaggcactgatatcagaaggtgagtttaacagccttcatgacacaaatgtcctttttcccaaagatggtttaaataaaggggtgacttcagggagtggggaggttaacctctgggttaaaatgtcattaatattagttgtaaaatacactggctaacatttattcaactttttttaacataaccttgccaaggtaaagatttataatactagtatttttttttttttttttgagacagggtctcattctgttacccaggctcgagtacagtgacacaatcataactcactgaagccttgacctcccaggcccaaatgatcctcctgcctcagcctcctgagtagctgagactacaggtgcaccaccttccctggcaaatttttaactctttttgtatagatgtggtctccctatgttgcccaggctagtcttgaactcctggtctccagctatcctcctgcctcgacctcccaaagttctgggattacaggcgtgagccaccgcacctagctactgttattttatttctgaggatagtggtaggttaaagagctggcacagtggcatgtgaagccagtatagaaatcacaaaccctgtgtgacccaagactgtgcactattttatttttttcatgggcaaaatattgtattagatcatatgaaatttctgatatttcaatttctttgttgatgaaaatggcttcatatagttcaatttaaaacatgatgaaaatgagacaggagtttcttatttccagctaacattctaaagatgtaaataaatttggaaaaattgtcaaagtcacaaaataaaaatctaccatgcacagataggaaaaaatgtttgcatttttccaggtttcattttatatccttcaagtcgtcatttagacgggaaagtaaaagcaaaaggtgaatggagtatacatatatgactggcaatagagagccgagggagtggaattagaataaagtagtatagggcaggagttggtcctgacagtaggtataggcaaaagcatatcaggacatgatactaggaactgctacggtaaacttccaatcgttcagatcatctgagaatagagaggggctagcaaaacagataagttgtaagaacttggaactttggcaacatagagttacagacctaatggtctctagcgtcaacgacatttttgatatattgttagataacagacatccttatgattgtgcccagtgtttctcaaactttaatgtacatatgaatcacctggagagtgtcaaactatgcattctaagtcagtaggcctgggttggggcctgagattctgcatttctaacaactgcccaagggatatcaatgcttcggatccattaatcacattttaaggagcaatggtataagtcactttgagttggcctttttgtcatttgcagtaaatggcattctaagacgtagtatttttcaaatgattttactcgagagctgtcatcccacccccggacatgaaaacgtatctgtatgaacataaaggaattcaatgggaatgccagctttgctttacagaaactctgttagaatgtaggaaggcggctgggtgcgatggctcacgcctgtaatctcatcactttgggaggctgaggcggcggatcacaaggtcaggagttcgaaagcatcctggccaacatggtgaaaccccatctccactaaaaatacaaaaattagccgggagtggtggcacatgcctgtagtcccagctactcaggaggctgaggcaggacaattgcttgaacccgggaggcggaggttgcagtgagctgagttcgcaccattagactccagcctgagtgacagagtgaaacgccgtttcaaaaaacaaaaaagaaagaatgtaggaaggcaattattctttaaccagtgttgtccagaacttactaaaatgatgtaaatattctatgtgtgcactataggtatacatatataatggacactagtcaggtgggaataatgaacacttgaaatatgtatggctagtaaggctcagaaactgaatttttaactatatttaattataataattataatttacctacacatagctagcggctgcaatattggacagcacagctataaaccgacagataattagattaccaatatccgtgaatccttatttgcaagtacttatccataccaatttattttgtcctccaatgtctatgaggaatgacatcctaagtttagcaatctagcaataaacattaatagcattttttaaaattttcattttccatatacaaatttataaatgcaaaatagtacatgttttcattaatttcagcctgtatttgatggtcctaatagcattttttgtgctttatggaaatacattataaaatgtataaacatatattatgaaaacataatcatatgctaggcactaactaataaaggcataaatggatagactttataaaacctagaggactacaattaaaacttacaaattaccaagaggtgtgagctctttaggaagacaggctctcaggcccaattccctagaattcacagttactggcatatatgcaatcctcaatttaaaaaaatacacctaataaaaggaggtaatgtattataatgaaagtctagattagaaaagaactaccagtgatgttcaattgacatgtcttacatgtaaaatacaattacatgatttaagtcagaaataaaacctgtataatatgatttaagggaaagataccagtacaaattagagaaacttaatttttaatgcatgtttttacttttaaatgcacgccatttagaaactaaaattgtactgatgaaaattggaattgatttatttacttattcaaaatgatggctcaggctgggcacagtggctcaggcctgtaatcccagcattttgggaggccgaggtggctggatcacctgaggtcaggagttcaagaccagcctggccaatagaaaccccatctctactaaaaatacaaaaattagctgggcgtggtggcaagcactttttaatcccggctactcaggaggctgaggcaggagaatcacttgaacccggggggacagaggttgcagtgagctgagatcacaccacttcactccagcctgggtgaaagaacaaaactccgtcttaaaaaaatagataaaaataacaaaacgatggctcaaaaattctagcaaggtggttcttatagatagattagttttggttttagcttaacaattctttatatgcaactagatgcttctagaatgctgtcatctgcttaaataagtaatttttaaaatcaactttgtttcagcttttgtttcattctctattaagaaaggtattgggggctggggaaggaatagcattaggagaaatacctaatgtaaatgagctgatgggtgcagcaaaccaacatggcacatgtatacctatgtatcaaacctgcgagttgtgcacatgcatcctagaaattaaagtataataataataataaaagagggagagaaaaaagaaaagaaatccaagataggttaaaaaacagaaagttattaattgaggtaatgtttaagtccggcttttattcaaactatcacagataggtgaattagtggaatttatataaataatgccttaatataaaaaggtactaattgattagaatcactgagagaacttttcaaaatgacgtcccagccccattccccaacaattcaatcagaatatctgggaatggagcccaggtattggttctgtaaaaaactatccaaccaggtaattcgaatgaacatccagggttgagaacgattgtgcctcttccccgcccccccccccgccccaggacacagccataatttttactttagcccttgggtcctcacaagtggcaaatacctggaaagctgtatccagacaacatgacttgttagggttaacatgaaccagatgcacagaggtaacatggagacaaaggatcaggatgcacaaacatgcgtttacttatttataaatgacttccacaagtactaaaatatctattatgtacccccagaaattacaaataaaaaagaagacttactaaagagtaattttgatcttgtagaatttggggcttttaaatataatttttaaatacaaaataataattgtgtgtcagaaaaaaagaggtattattgtaattaatcctattgattcagcaactgatattagccccaatttacaggtggggaaacaaaggcttacttgggtcaaaacgcaaacaagggaaggtgacaaagtgggaactcaggtagtttggctccggggcctgcttcacaatcatgcaatattgcctgaactaaaattaactttttagagattaactttatatctattataaagtcatttatggcactgattataaatattaaaaaaatagaaaacagaagttcatttggtggaattttatacagagattgtcattaataattttattattttcaccaaaacgaaaattacagttgttactcttgagacaattgttcttagcatgatgtttactttaatgatagaaaccacaataccctattttttaaatttttatttttttgggtatatagtatgtgtttatatttatgggatacaagagacatattcatacaggcatacaggcataatatgacattagggttaatagggtatccatcacctcgagcacttatcatttctttatgtgacaaacattccaattatactttttgttattttaaaacgtacaacaaattatgtttgacagtaatcatcctgtcgtgctatcaaatactacatcacattcattcaatctaactatatttttgtacccattaatgatccccactgcccccgacccactagcattcccatcctctggtaaccatcattctagtctctatctccatgagttcagttgttttaatttttttttttttttttttttttttttttttttttttaagctctcacaagtaagtgagaacatgcaaagtttgtttttctgtgccgggcttattttaatcaacataacgtcctccagttccatccatgttgttgtaagtgactggatctcattctttcttagtcaagcttaagacttgtcatttttgtcaaccctttcaaaaaaaccttctttttgttttgttgatcttttgtatcattttgttgtactttaatgtatttcagctctgttccttactgtaatatttattttctcatactaattttgggtttggtttgctccttcttttctagctctttaaggtgtatcattcaattatttgaaagttcttctgcttttttgatgtaggtatttatacctataaactttcctcatagtactgctttcactgcttcccataggttttggttacattgcgtttcctttttcattcgtttcaagaaattctatagtttccttcttaacttcttctttgacccactgataattcaagagcatattgtttaatttccatgtgtctctatagtttccaaaattcttcctactgatatcttgatatattcagttgtgatcagaaaagctaatttatgttattttgatttttgaattttctaagacttgtttcgtggcagaacatatggcttgtccttgaaaattatccatgtgctgagaagaagaatatgtactctgcagctgttggataaaatgttctgtaaatatctattagttcaaattggtctacactgcataataagtctgatgtttctttgttgattttatgtctggatgatctatctggccactgctgaaaatggggaattgaaatcaccggctattactgttttggggtctatctctctaactctaataatatttgatttatacgtctgggtgttccaatgttgggtacatatttatttacaattgttatgtcctcttgctgaattgacccctttatcattctacaatgaccggcgttgtccctttttatagtttttgtcttgaaacctattttgtctgataaaagaatagctaatcctgttcttttttggtttcgattggcatggaatacttgttccatccctttattttcagtctatctttatctttattggtcaagtgtgtttcttgtaagtaacagattattgtgtcttgtatattcttttatccattctgtcactcaatgtatttagattggatagtttagtcaatttacattccatgttatcattggtacgttaaggacttaaacacttcccattttgctatttcctttctggttgttttgtggccttctcttcattctctctttccttcctgtcttactattaatgaaagtaattttctctggtcatatgttatacattcttattaatttttatgtacctgagtacattatttgatttgtggtaactatgaggtttgtaaagaataagttataatccattatttgaaattcatgacaacactggttgcataaacaaataagcaaagagaaaactaaaaaaaaaaaaaatgctacactttaacttcatccccccactctttttgttgtttctatttatatcttattatagtgtctatgtcttgaaaagttgttgcagttatttttgataggttcgtcttttagtctttttactcaagatatgggtagttgagacatcataatcacagtgttataatattctctttgtaacagaatagtaacaaaccttactatcaccagtgagttttgttacttcagatgatgactcattgctcattaacatccttttctttaagattgaagaacgccctttaccatttcttgtagaaaaggtttggtgttaatgaaatctgtcagcttttctttgtcttagaaagtcttcatttctccttcaagtatgaagaggattttcatagatatactattctagaataaaagtcttttccttcagcactttaaatgtatcatgccactctcctggcctggaagttttccactgaaaattgtgctgccagacatactggagctatttctatgtgatttttttttttatatgattaccgcttttaagatcttttctttatccttgacctttggaagtttgatttttaaatgccctgaggtagtcttatttatattatatctccttggtgttctattatcttcttgtacttgaattttaatctctctctctaggtgggggaagttctgtgttattaccctcttcaataaactttttaggacttttttgtctcctctgactgtatttacaaatagcttgtcttcaagctaattctttctcctgcttgatcaattcttctgttactcgtctctgacgcattcttcagtatgtcagttaaatctttcaactccagaatttttgttcgattctttttatttcaatccctttgttaaatttatgtgtaggattctgaattccttctctgtactatcttggattttattgagcatcctcaaatcagccatttggaattctctgtctgaaaggtcacatatctgtctctccaagattggtcagcgatgccttatttagttcagttggtgagatcatgttttcttggatggtcttgatgcttccggatgttcatcaatgtctgggcattgaagactttggtatttattgtagtctttgcagtatcggcttgtttgtatccatacttctcaggagggctttccaggtatttaaaggttcttgggtgttgtgatttattcctttggtcactgcagccatatatgcactggggtgcacccaagcccagtaatgctgtgactcttgcagactgttaaacgtactgccttggtgatctttgggaagattcaggaaaatcccctgtattacctggtagataatctttttctctttccttcccctcaacaaagagagtctctctctgtgatgagctgcctggagctaaaggagaggtgacacaagcacccctgtagctaccacgactaggattgtgttgggtcactcctaaagccagtacaacactgggtcttgatcaaggcccacactgaccactgactggctatcacctacattcactcagggcccaaggactctacaatcggcaggtggcaaatccaatgaagcttgtgtttttcacttcagggtagcaatttttccctggtgggtttgcaagatcctatatgtaagccagggcctggggtcatgtattaggccattctcacaatgctataaagaaatatctgatactgggtaatttatgaagaaaagaggcttaaatggctcatggttctgcaggttgtccctgagacatgatgctggcatctgctctgcttctgcggaggcctcaggagatttacaatcatggcaaattgcgaaggaggagcagtcatgtcacacggccagggaagaggtgagtgggagggtaccacacacttttaaccaactggatctgacaagaattcacccactatcatgaaaacagcactaagaggatagtgctaaaccattcatgagaaattcaacgccatgattcattcggctcccacccaggccccacctctgacagtgaggattgtaattcaatgtgagatctgggcaagaacatacatccaaaccatactattccatcctggcccctcccaaatctcaagtccttctcacatttaaacatacaatcatgtcttccaaacagtcccccaaggtctttacttattccagaattaactcaaaagtccggagtctcatctgagacaaggtaagtttcttctacctatgagcccgtaaaatcaaaaaccaattagttacttccaagatacaatgggattataagcattgagtcaacactcctattccaaaagggtgaaattggtcaaaagaaaggtctcatgcaagtctgaaacccagcagggtagtcattaaatcttaaaactccaaaattatctgctttgactccatgtcctacatccagggtaaactggtgggagtggtgtgctcccaaggccttgggcagactccaactttgtggctttctagggttcagcttccaaagctgctcttatggtctggtgctgagtgtgtgtttcatttccagatacaagggtcaagctgtcagtggatctaccattctggagtctggaggacagtggccctcttcttacaggtccactaggcaatgccccagtggggactacgtgtgggggatcaaagcccacattttccctctgcattgccccaggagaagttctctgtgagggttctgcccctggagcaggcttctgcctggaaacccaggcttttccatacaacctctaaaatctagatggatgttcccaagcctcaactcttgcactctgtgcacctgcaggcttatggcttgtacccgctggagctgtggcccaagctgtacttgggccactctgagccacagctggagctacagtggccaggacgctgggtgcgggggggaggggttggggcgggggcacagtgtacgaggttgaacagggcagctgggaccctgggcctggcccaggaaaccattctgtcctcttaggcctccggatctataatgggaggggctgccttttagatctctgaaatgccttccaggcctttttccccattgtcttggctatcagcacttgccttctttgtaggtatacaaatttttctagcaagtggttgctcagaagccttcttgagttctcctgaaaatgggcttttattttctaccacatatccatgttgcaaattttgaaaacctttatggtctgctttccttttaaatatacatgtataaatatgtaaaaaacctgcacgttctgcacatgtatctcagaacttaaagtacaataaaataaaataataaatattccatcttatttctttgctcctgcatcagagagtaggttgttagaagtggccacacaacgtcttgaacattttgctgcttagaaattcattccgtcagacacacgagatcatcactctcaagttcaaactttcacagatatctagagcatggacataatacagccaacttctttgctaagggataacaaacatgtcatttactccagttgccaataagttcattctttccatctgagacctcgacagcttggacttcactgtgcatatcagtatcagcactttggtaacaatcatttaaccagtctctaagacattccaaattttccctcatctgtcttcttctgagccctccaaactcatccaacttctgtctgttacccaatttcaaagcagcttctacattttcaagtatcttgacagcaaagccccacttcttggtaacaattttctgtactaggccactctcgcattgctatcaagaaatacctgagactgagtaatttataaagaaaagacgcttaattggctcacagttctacaggctgtacaggaaatatgatgctggcatctgctcagctgctggggaggcctcaggaaacttacaattatggcagaaggtgaaggaggaacaggtacatcacatggccacagcaggagcaagagtgagagggagggtgccacgcttttaaacaaccagatcttgcaagaatttactcactattgcaaggacagtagcaaccaattatgaaaaatttgcccccatgatccaatgagctcccactaggccctacctcaaacactgcagattactacaattcaacgtgagatttgagcaggcacacatgtccaaactatatcaactcaagaacctaagaaatctacctggtgctctattctactgtggctaagctggcaccccacccaaaagataaagtccttccctctcttctctcccctttccacaaacagagatgtctctcctcatggccacgacgactactgaaccaaagagagtactgtctgaggtccaatgttcactcaagggccaaggccactttggccagcctgtggtgaatgctgtcagtcctgagtctctcccttcagggcagtaagaaaatggaatccaggagccaaactctggaatcagggaccctaggagcccacttgatgctctgccccactgtggtcaaactggaacccaagctgcaagccaaagtcccctttactctcacctctcctttcctgaagcagaaggattctctccctgtagccaccacagctgggaatgtactgggtcacacctgaaaccatcacagctctgagtctcacccaatacccacagcaagtactgcctggctacagctgctgattattcagggccctaggtccctttggtcagcatgtcatgaattctgccaggacggggtccttctcttcaaggtgacaggctctcttctggcccagggtgtgttcagaaatgttatctgtgagctagggcctggaatggggacctcaagactctgcctggtgccctatcctattgtatgtctgagctggtatccaagcagcaagacaaagttctctttcttgtctcctctcttcttcataagcggaaggaaggagtctttcctggagctgtgagctgtgctgcctggggttgggggaagggaagcacaagcagtcccttagctgccccagcggatgtctcactaggttgtatgtatcccaagtccactgactctgagcccggcacagcaccaggacttgcaaaggaactgcagtccttgtggcctagactacctttgaagtttatttagaaccacagagcactctaatccatgatgacaaggcttgccggaactcaggttccaaacactgggatggatgattcttccctgtctagggttcatctaaatgctccctctgcgggatttggctgagttctgttctttgtcggtttccactgtgacagggcagcactgattttcaatgcaaagtcctataatcactgcaatctcccttctgcaagcacatagactctctcttcatgccatgtgactgctgccatggatgagggagagctggtataggtgatagaatattgcctttactaccctcttctgtgcctctttctgtgatacaacccaaaaaccaggtactacgatcatgcacctaatttttcactcttatgaaggtgcttttctagtgtggacagttgttcaatttgatgttcctgcaacagggataattactggaggcttctgtttggcgatttttctccacctcctccacaataaacttcgagactcattttccctcaaatatatggtgaccatataaaatgactagatatttttaaaatgtatggtgtatcattaaatataggaatcagaaatcatgatatattataatccaagaaatggcaaacatgttttaatatagaaaagcaacattcatttaaaagaaaagcttgagtagtgcatgtacaaacatatgcacatagttttttgttgttgttgcatggcaataatgaatggtccataggaagcatattagtatttttcaactcccaagatttataacgtttatcaaagttcaataagtggcctgtgaaatataagctttaaagccagaatccaaacagaaccaattaccccctcaaatgtgtaagacttcagctgtcactgttttcactatctcatcacctttaccacaagtacatccatcgctattgtcctctagttctcatgctaactttctgaatgggtaccctcagcatctgtgaagctgtagaaaccctactggcctagtttacctacttgcctcagtaactagatctgctttcctccaaattctggtattccttactagactcagctgcaaagcctgacactgcatggtgtcacggtgtgtataaatcttaggcactaatatagtagtttccattggagaatgaagtgaggcaaggtctgacaaaattatacagtttttatccccctaaaactaatgtgttcattctcctctttacagcaccttctttcccaacacgaagtatgctgacatcttgggctaggaaagaagccaaggagagcatgtcatgtatcattttcaaaaattcccactaattgccatagttattatactgcaccctgcaacctgatcttggaggtcaaactttaaattacaacctcacagtaaatagttcagaaagaacctaatataaagttccccatccaacaactagaaatgaaggaaaatgttccagtttttcacaaaattaaacatgcactaacatttattttcctacttaatggaatgtgagaaatagtattgtttttatactgaattctatgagaaaatcgaaaatgtgtcattgttttcaaatcctgatccatttttgtcctccatccatatagctgaacagtttaattattaatatttttcaactatccgaggcaacattaaagttcaaatgcaaacacatttattttcattttgaaaacataaattcagtttagtaacaataacataaagaagctgcgtggctggatgcaaaagattcttggccaggcgtggtggctcatgcctgtaatcccagcactgaggctgaggaggctaaggcaggtggatcacgaggtcaggaggtcgagaccatcctgaataacatggtgaaaccccgtctctactaaaaatacaaaaagttagccgagcgtggtggcgggcacctgtagtcccaactactggggaggctgaaccaggagaatggcgtgaacccggggggcggagcttgcagtgagccgagatagcgccactgcactccagcctgggagacagggagactctgtctcaaaaaaaaaagaaaaagaaaaagaaaaagattcttgtggcaaatacattatggcaaccctcaaatcaatcttcctgattaaatgcttttaaagaaaataaagaaattggcagatgtcatcaggagccaaggacaaatatgaatatatcacgtttggaagactgtttaaattatctctagtaagaataggtaatgttgacactctgaaattctattcatttatgtggaaatagaagctcactctcaacttcaaaaattttgccactacatagcatctggcacagtgcctggcacatactacacactcaataaatatttcttcaatgtataagtagtataacttaattatgaacaagacatagttttgatatttctgattgggaatttttgtactaagattaaaatgtcaacttctattaaatctgctctctgagatagtctattagtttaatttgaattgttccaacccctggctgttacccagttccaaagtcacttccacgtgttcgggtatctttatagcagcaccccactctctgcggtaccaatgtactgtactagtctgttctcacgctgctaattaaagacataatagagactggataatttataaagaaaacaagtttaattgactcacagttcggcatggctggggaggcctcagaaaaaatcatgatggaaggggaagcaaacatgtccttcttcacatggcagcaggaagaagggccaagcaaaaggggaaaggccccttataaaaccatcagatcttgtgagaactcactcactatcatgagaacagcatgagggttacactcccatgattcaattaccttccaccaggtccctcccacaacacatggggattatgagaactacaattcaagatgagccaaaccatatcagcattatttatctttgtgagaaagcattgtttttgaagatacggctctctcatttctgtgaattccagaaatttagctttcctgtaatttaaactatgagtcacatgcattgtattattagtacaagagatgtccacatttagctgcattatcacatttttaattattgacagaaaaattattatgaccataatccatgtgcaacctaaccgaatgtcacgttatcatctataaataattcctacttcttattagtccaatagcttaattatcaatactcatcaacactcatatattgtctgttatatattattgcaccagaatcttgctactgcttaatcacccatggggtatgatatcaacatatgaggactgaatgaaatatcagcaccatttttagagctcctgagaaagtaattaaaatatttggcccacgtcacttgatagaaaaataggaacagaagatatctaagtagaggtttacaaagaagttgagatttctactctgtcttaatttcagttagatcagtgcttctcaaacttaaactgatcagggatcacctgggatattgctaaactgcacaattctgattctgtatatatcagaatgagagctgagagtctgcatttttaacaagttctcaggtgacgctgatgctactggtcctacaccaccttgatctgcaagttactattgcttaacattactggaagaagtaaaacagaaaaatcaatgaacttaccaaattgtgaaataaaatcacaattaggagtttgagattgtgcacctccaaagtatttactgcaacgaattcaattccaagattggaattacctgaataacttaatttagttgttcatctattcattcatatattcacatacgcaaacttcactgcacttgggagaaaataacccactcatttgttcagcacctccttttctctatccactctcacatatgccatcttatttccagagtcaaatagacacttgggggaaaaaaaaagagatgagccatatttgttagatgtatttttctgtccagtcaaagcattgatggtgattcacaattattttccatattatggcttgtgtatctacccagatactattcatatctctcctcctgctgatataaaccaaaaaacacaacttcacttggcctcctgacttgctttcatttttttcccttaccgtcacagaagttttagtttctgcctgcatgtcctaactacaattatcagaaaagttgatggaacttgctgtgcttaactttgagtccttataaaaatgtcagtaaatcttttttgctctctgcaggttgcatttttcaatcaaattaattagtttattcatagagaagaaaatcttctgttttccctgtgccagttgtcttcttgcacttccacagttggaagttgtgtgtttttcttccgaattccttacctcctaccatcccaagtgtattccacagcattaaaaaaaaaatcattggcttactcctcttaaggggttctaacaaaaccacatcaatattctcttgttttaaacactacattatgaaaggaatggcacttagttttctcatttaaatcatataaacattggtaaagttttgtaattgaccagtatcggcacgtgccaaactcatttgtgactggagatgtgttaataaacttctttattgtattagcttttacctcatcagaaatttatgtccataaaagcaacagaattggagggaaaatacaatagcaaggaaagaatcaaatgagagtgtggttatgaaggagaaagaaaggaggaagtatctgtatggttatctttcctgacattcctttgtaagcatatttttaaatgttgccattgtgaaaaaataactgcaaatgtatttctaatcatcctgctcatgctcccttatccccatacaaaataaccacagctatactctttgggaaaaaaaaatgactgaggcaattagaaaaggctggagaaaaaaagtaaaaaacatctatgagggtcaggtttggtagctcaggtctgtaatactagtactttgggaggccaaggtgggagaggatcacttgaggccaggagcttgagactagcctgggaaacataacaagacctcattccctgcaaaatttttttaaaagttaaaaaattatatataagttattatacaaaatatatgaaatataattatatataaaattatataatacttcatatagaaaatatcaaattacatataaaaagtgacatggtatggtaaaatagttaactgacagctcatcatcttatttatcacagttatctttcttcacattttataataattttgcattcacaaactaactttttataccctatctcatctagtatctttcagaggtatgtcagcctcatgacactattgctgttttacaaaactataaagtagagaacagaaaagaaaagtatattgccccagttcacataaataagtgtttgagaaagcaagcccttattccttaggcaaactggagaggattttatgtaaggcagaaatcagggcacgctattatctttgtatttttaatatttcttgttttgcataattgttgatggtttatgggataaatattatttcctagatgcaacttgaataatagtaactgtgggcacaaattgaagcagtctatttccaaaggaaaaagcacttttactgtcaaaaggaaaaaaaaataggaactaaaactaaacagagaagtggtttttaaaataactaaatggctaagatagtaaagtatacttttatcacaactaccagctggtctaagacactactgtgtcttaactggccaacttcactggcctaataactgtcctctcttcctccagtggccttcctgataggttttcttgacctatctctcacctacataaaatctgatggctttgtcttgcacttagtctagaattcaaagcccttattcaaagccctgactgacactacaatatgtaatcagtctcctacctatatttcaaccccatctcagacctcagccatctaacttaccaccctgcaactctacagtccccctggccttttggttcctccagcaagccaaactgtccctatttttgggcctttgcattagctgttcctaatccgtgaaccacacttccttgtgatctgcaaatagtggtaccttcttgtcattcaaatctcaaactaaatggtaccaaccttcaaagtcttacctggatcacaaagtctaaagtagcctcccctcaaccattctctatcacattacattttaatctcttcaaaaactatattcctatccggtatttttcttgtgttcttttttttcttggctgccagcctctacagaatatgtttcatgagatctggggccagaccttgtatgatcattattgagtctccagtgccattaattgtttttgataatgtattccattaatatttgttcatatagagagatatatgtgtattttatacgtatatatatatatatatatatatatatatctcacaatgactatatatcaaatataatttgatgttgctattaggttggtacaaaagtaattacagtttttcccattacttacaatggaaaaaaacatgattacttttgcagcaacctaatagtaagtatgttggtagataggattaataattgctaagtgtaaatgttcatagattttagtgataagcttatctgtatttacaagaagtttttaacttttgttatatcaacttagaaattatagcatagctttggatatacttaatatgactagacaaatgttaattatcatttctctaatcgctaaaccaaggcttaggcaggaaataatggcttccgactggatctatccaaaccctgtcttaggtagagagagaaaagaagtatcgatgaatccatttttgtttactagtaatcttctactctgaagtaatcatatatttagaaaaaaaataggtaatgctccaagttgaagctaatcattggagataatccattctcatgaccatgataatggaaactgaacaggttataatttatttgaagcattaagtaaaacctagattagttttttaaaaataatgacaataccctcttttcataatcacgttttttgtttcctctcacaaaatctttcaaaaatcaggttcagcaaagcttacataatggcttatcacattagaatttaataggttttatgcacgaacacatacatagtcaaagtggcaaggaagactgttatttataaactctcatattatttctgaatttgtgttgctcaaataatgctttgtatattcatttttaaggaattttccagaaaagtctatgtgatagaagtggttacatgtacgtgtctcattttaaaaactctgtgagatgttttagcaaaagctataccagctagaaggctctccttgccttcttaataattattctaaaagctgtaacacgtacaaaagctcttgaatcttccctaaggacaaactaattttttatgtcaatctcagctaggtggtaatactgccattttagcatttccattctctagtgggatggggatgaggaaattacacgcacagaagtctaggtgtctgtcatccttcacttaatggcagacatcccttgaaggggggaatttttgaatgaacatctttttaaatgttagaatcacagataaaagactttttttatgtttcagataagcaaagaaaaagttgcaattttaattccaggaggaattcatattttcttgcaactcaatttcacacagcaattaattaactgattagtatgaataattaatgccatattgttagttttattgaaaatggggagtgtaagaaaaatgagagcatttagcctccaggagaggatggaaacctagagtgcacaaaggagaagacactggtggctattatggcaaggacagtaaagaggtggttggattttcaaaactttctaattttgtttgaggttgctttaagttccacagatcactgcaaatagaagttctaacctgaagaatgttggcatatgaccacagaaggcagcttatatcttaatatcgataatagatggagtaaattagtggacctggtaaacactggggagtgggcagactcaacagttataatatgattattgtacctctcacatctaggggtagtgacaatcatcaccacgatcacagcaggcgaataatatcaatatgcatagattagtatctcctggcttggaatacatatatagttatgaaacctctatcttacatgtaccttatttattctttcaaaaggcctgagcttaaaaatgtgtttttcccctccataatttcacactataatttagtactggaataccaatccttctagcatatctaatgagtttccttggtccttttttttttttaacgcttttgaacttcataaataatagttaaataaacttaaggcatttggacaatttttttcacttaatgtattcaaatccacagttggcacttcatttcttttcatttaaaaataaatctatcttgtcttgataggctttacatgaatatacacacctaacaatataaatcaaaacacatatccagaatgatgagatctgcttgttacctttataagaaatatgtcatttttcagaaatgtctcaaatcctcttttttattaagtcaatatatattcttaagataattcatagccatactgtattttaataagaatttcccaaaacgtttgaataatgtttttcaagaggatttccatatatagatgagtaactctttaatattttcaagggctttttcttcagaagagaagtttcgtgtcaactatagctaataggtgattttatgtacacaatctcctgtgcatgcttctgtgccttttatagtgacattttaatgtttggaggaaaacctagaaaataataactatgacagaattttggcaaatcttaaaacatagttctgtagataacagtgcatctatctaacatctgctcttttagttacaaaagtgaaaaccaaaatgttatttctatgaaaatccaaccagtctcccttgaaagaaagctgtgtgccttgggaacaaactgagaatcgtaacttaaccatcaaaccacatcaaaataatcacaagcttccaaaacttgttagtcttcttaattaaaaacaaataaggacttacttgctttgtttttccatgctagctaccctgaggcattcccatcttgaatttaggagattcatctgctcttgtacttcagtttcttcatcttctgataattttcctgttccaatcagcttacttcccaattgtagaatattaccaacccggccctgatgggctgtcaaatccatcatgtacccctgacaaagaaggaagttaacaattgtaattagaactctaggtaaatcggtgtggttttgagttttatttgtttgcagttttaaacttgtggcccatttagatttatattcccagtaaaaggaatttaatttgtatttgcagaatcccaaaaccacttttaatatgaattaaggaaaattatcttaagtcaagttcttcagaagcaggccccgagataaggacttcagtgcaagtgatttattaaggaagagctcccaggaagttccgcaagggagttgaagatggaggaaaaaggacagggaagggaaagaagccaaacgagtgtatcatctcaggaaaagtctcccactgagagaagttaagcccaataccatacatcaactcaggaatgtaagtaatgcctcagcactgccttgacacaagagaaagaagttgggctttcgtattcctgttggccgatcaggtagaaatgccttcaatggttgctctccaaaagaaaacttcaaaatctgactgttggaatcccaagcacatcatagtaactaaatttccaaaatacaaggatgtaagagagtaattgaggaaaaaggatgacttgccattataacaagtcatatgttttgttttgtaaattaacgttttagtttacctcatgagtatgaaactggtctttcaccacttccacatcattagaaatctctccttgtgcttgcaatgtgtcctcagcagaaagaagccacgataatacttcttctaaagctgtttgataacggtccaggtttacttcactctccatcaatgaactgccaaatgacttgtcttcaggagcttccaaatgctgcacaataaaataaattgggtgttacacaattaatgtctttgcagattgttccagtacattaaatgatgaatcgaatgaaatatttaaaatgctaggactgtccactggcattatcaaacacaggaacagcagatacagacaatagggagttttcattttaacttcctcatgcatacatcaattttcaaatagcggtcaaaatccacaccaaattaatattgtattaaagctcttctagattactggaaggagtaaattagtatatcacctcatgttgctttttaaatgctataaatattgatctgtaggaactttcctcatttcttatttataataacttacatatacattatcagaattatatttacatacctctgcaatggcattaaaggaaatatctcttcctgagaggccctaggtaatgaaatatttccaaatatttacagaccagtaaaggcatcagtaagaaaacaaggaggtaggggaaaggaaggcaaaatttagaaagaaaaaaaatacctcacccacccatctaaaatttctaacagcataatgacttctgtgatttagcctttatttccagaaggccacgatttaaatagtaagacattatcttagaagaactaaaatatgaagtatgctttacccaatttaattagcaggatattaagtgagaatgcaaatggttgtcttggaatttccgtctggaccctaaagccaagagcaaagtgtacgaagcatccataattctaaagagaagatccagggtacctgttaaaaaattgctaagaagtgatcacaaaattggtctcacaacccttaatccaatatctagcttaaaggtgtgtaagagcaagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaatactatccctcccccctccccccaccccactacgggacccagtgtgtgatgttccccttcctgtgtccaagggttctcattgttcaattcccacccatgagtgagaacatgtggtatttggttttttgtccttgcgttagcttgctgagaatgatggtctccagcttcatccatgtccctacaaaggacatgaactcatcctgttttatggctgcatagtatttcatggtgtatatgtgccacattttcttaatccagtctatcatcgatggacatttgggttggttccaagtctttgctattgtgaatagtgccgcaataaacatacgtgtgcatctgtctttatagcagcatgatttttaatcctttgggaatatacccagtaatgggtatattactgtaatgggataaaatgggatggctgggtcaaatggtatttctagttctagatccttgaggaattgcacactctcttccacaatggttgaactagtttacaatcccatcaacagtgtaaaagtgctcttatttctccacatcctctccagcacctgttgtttcctgactttttattgttcaccattctaactatgtgcaatggtatctcattgtggttttgatttgcatttctctgatggccagtgatgatgagcatttttttcatgtgtctgttggctgcatcaatgccttttttgagaagtgtctgttcatatcctttgcccactttttgatagggttgtttttttcttgtaaatttgtttgacttctttgtagattctggatattagccctttgccagatgattagattgtaaaaattttctcccattctgtaggttgcctgttcactatgatggtagtttcttttgctttgcagaagctccttggtttaattagatcccatttgtcaattttgactcttgttgccattgcttttggtgttttggacatgaagtccttacccatgcctatgtcctgaaaggtattgcctaggttttcttctaggtttttatggttttaggtctaacatttaagtctttgatccatcttgaattcatttttgtataatgtgtaaggaagggatccagtttcagctttctacatatggctagccagttttcccagcaccatttattaaatagggaatcctttccccattgcttgtttttctcaggtttgtcaaagatcagatagtagtagatatgtggcattatttctgagggctttgttctgttccattggtctatatctctattctgataccagtaccatgctgttttggttactgtagccttgtagtatagtttaaaatcaggtagtgtgatacctccagctttgttcttttggcttaggattgacctggcaatgtgggctcttttttggttccatatgaactttaaagtagttttttccaattccgtgtagaaagtcattggtagcttgatggggatggcattgaatctataaattaccttgggcagtatggccattttcacaatattgattcttcctatccatgagcatagaatgttcttccatttgtttgtgtcctcttgtattttggtgagcagtggtttgtagttctccttgaagaggtccttcacatcccttgcaagttggattcctaggtattttattctctttgaagcaattgtgaatggagttcactcatgatttgcctctgtctgttattggtgtataagaatgcttgtgatttttgcacattgatttgtatcctgagactttgctgaagttgcttatcagcttaagtagattttgggctgagacaatggggttttctagatatacaatcatgtcatctgcaaacagggacaatttgacttcctcttttcctaattgaataccctttatttccttcttctgcctgattgccctggccggaacttccaacactatgttgaataggagtggtgagagagggcatccctgtcttgtgccagttttcaaagggaatgcttccagtttttgcccattcaatatgatagtggctgtgggtttgtcatacatagctcttattattttaagatacgtcccatcaatacctaatttattgagagtttttagcatgaaggttgttgaattttgtcaaaggccttttctgcatctatggagataatcatgtggtttctatctttggttctgtttatatgctgcattatatttattgatttgtgtgtgttgaaccagccctgcatcccagggatgaagcccacttgataatggtggataagctttttgatgtgctgctggattcggattgccagtattttattgaggatttttgcatcaatgttcatcaaggatattggtctaaaattctcttttttttgttttgtctctgccaggctttggtatcaggatgatgcttgcctcataaaatgagttagggaggattccctctttttctattcattggaatagtttcagaaggaatggtaccagctcttccttgtacctctggtagaattcggctgtgaatccatctggtcctggactttttttggttggtaggctattaattattgcctcaatttcagagcctgttattggtctattcagggattcaacttcctggtttagtcttgggagggtgtatgtgtccacgaatttatccattccttctagattttctagtttatttgcgtagaggtgtttacagttttctctgatggtagtttgaatttctgtgggatcggtggtgatatcccctttattattttttattgcatctatttgattcttctctcttttcttattagtcttgctagcgatctatcaattttgttgatcataaccagctcctagattcattgattttttaaagggctttttgtgtctctatttccttcagttgggctctgatcttagttatttcttgccttctgctagcttttgaatgtgtttgctcttgcttctctagttcttttaattgttatgttagggtgtcaattttagatctttcctgctttctcttgtgggcattcagtgctataaatttccctctacacactgctttaaatgtgtcccacagattctggtatgttgtgtctttgttctcattggtttcaaagaacatctttatttctgccttcatttcgttatgtacccagtagtcattcagcagcaggttgttcagtttccatgtagttgagtggttttgagtgagtttcttaatccagagttctagtttgattgaactgtggtctgagagacactttgttataatttctgttcttttacatttgctgaggggtgctttaacttccaactatgtggtcaattttggaataagtgtgatgtggtgctgagaagaatgtataatctgttgattaggggtggagagttctgtagatgtctatgaggtccgcttgttgcagagctgagttcaattcttggatatccttgttgacattctgtctcactgatctgtctaatgttgtcagtggggtgttaaagtctcccattattaacgtgtgggagtctaagtctctttgtaggtctataaggacttgctttatgaatctgggtgctcctgaattgggtgcatatatatttaggatagttagctcttcttgttgaattgatccctttaccattatgtaatggccttctttgtctcttttgatctttgttggtctaaagtctgttttatcagacactaggattgcaacccctgcctttttttgaaaaacattaatcttaattcctacattaaaaaaatggctctggcaaagattgctcatcctccaatatgtatctttcttcaccctttatgtagtattagaaagtttaggggacaatttggctatctagaaatgtcactacagttcccactttcccttgcagttagatgtggcatgtaaccaagtattggccagttggatataacgcatccaacttcgtcattaagacgtaaatgggcatagatatgctctcttcttcgtcctccctcctgaaggtcgtgatacacacatgaagctggtgagctatcctcaaccgtgactacgaagacagcgtcccaggggatgatcgaaaaactgggcaacaggactatggatccctgaatgagcagagacttcctacaaggcctccatcactcccatctacacaacatttaagagaagtaagtctgaaagagaaacaaactcattttttagttcatccatccttgtgtttttgttagtgccacgaaacctacagcaatctcatatactgatatactctaattttctagcagctgagattttactataaaaatgtatctgtaaaagcttatatgtgagtttaaaataaactttctactataaaatcagatgtctctctaaaactctactctgtctctctaaaacatactctcaatgaaggttccagtcattttgcttcatcgtttttcaagtcacatacctttagatattacactaacccttgcattgtaggaaggcggggacactgaccccgtgcctaacagcacagtacacagataataaatatttactaaattgtttggggtaattttaatttcttatttaaggtcatttgtgcttccaatttcaggttttatataaaatatgttttaaccaatcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtcttggctattataatccacacaatagaacctttctcataaaatcaagaaggaagaaaaagaaataagcactgttatggcaaattctcctaaatcaatggaaggtcagagagaaaataatagaagatttagagaaatgtacctagaacaatttaataacccaatataaaagatttctttttaaaagcaagtttataataaaattttcataagcatcaataaaaaaactttctcagaaatttattagatggcacatgaaagacgtctagcctagtgatttctttgttcttactgtttcatataattcttacaaacaccctaaaaggggggacctatttccaagatgaggatgaggaaatccaagtcacacctatgaggtgtgggaggaaaaatgggatacccagtaaacaaaccgacattccttggctgacagagattcatgaagtccagagaagaaggatgaacataataactctgtactgtttggtggatgtttcaataattttaaaagtcagtatttggttggaattcatatgagttggtaattgaaacgagattttgtaaaagtactaaatttaatttaaaataggatagttacaaaatgtctcagaagaccaaataaattcttaatgttattttccttaatcctaagtttaacaattttattaattttcaaatacgtctcatggaaaaacaccaagtcttatttattttaatcagtcatttataaataggaaaaaaatgattcactggatacttttaaaatgcaaaataattcagaagtaaactgctttagacaagtggtttttacataccaaaaaaatcaaaacaaaatacacatatctcgtgaaaacttattatttcaaattgacatatactgcacttaaataatattcctctagaatgaccgtagtccatagagtttgtaattgcatatacaaattaattgtgagctatgaggagaacctaaacataaatattcccatgtagcccgttttggaattttgctttttttctcatcatttataatattcttagctatgtactcatttattccacaagtctatatgtaaagaaattagaagttagcacaagagatgtccccaaaatatagaaacttatctacacttacactaatttcagtgaaaatcttattcttcctgttatttgatccaagactccttaaccttaagcttttttctgtaaagggctagataataggtatcttcaattttgcagaccactaaagaccagatgcccccaactcagctctgtcactgcaaattgtagccccaaagcatctggagacaatacattaagtgaataaacatggatgtgttccaataaaactttatttacaaaaatcaggtagcaagtctattttcaccctcaggccatagattgctatctcctgatgatgaaattgcttcccacatttaaactaatttctctgaacttctcactgttgattatctttcctctctccaatctctccccctccaattgattctcattgggtcactttcccactctattgcatgtccaagctagccatctctgaaatctcactgccctccccctgccctacctccattgctgtatataacaatgtctcaaagaaatcatgctgcataaaaccagtggccgcattcgggaaactttaagtcggcctcactttggagtaaaataaacatgaggtcaaattcaggttctggaatttataggtagtgtgtacttgaacttggcaaagttttttaatttcacactcttggtacacacctgaaaatagatatgatactaatttagagggtaattgtaaggctcacagacaacatacagcgattgtattgacattcagcatcaccctttgccattcaacttttataaaatcactttcactgcctcattgtttttatttagtgcaacccagaatagagaactaacaacaataaagaggagtttggttcaattagattttaggttgtaaaaatattctactaaattgacacatcttttctaactaggtaaattttctccaaggacattagctatattcacctccttaacatacaccagttgcttggtttatcccgttacctttcacatatatcactaaattctgtgtgctttctctttatttatgttacatacctttgtctcttttccttattccttaaacaaagatgtggtatatccttcataagggagagaaatccctatgggggaactaatgggtagcttcctgtctctacttcttgggcatctatagtgcttctgtgggatagtttcattattaaaattagggaaataatataaataactagtgagctaattaggaagacaattataagggtgtgattgtggaaatggggaagttcttttatgagaggtgatgtagcatctcggaagcctcacgacagtagacagtttattttgttcagcacctgacatacagtataacatactatatgtttgttgaatacaataatgtgtctcttagcatatgacatgtaacaatattccattttaccttatactgatatgaggacattttttttcctaagagaattagaccaaggcatctttccatgacagagcagggacaagaaatgacacaaactccacttgtttatttcacttactgccttcttcaatgcagtgttggcttccctattcaaggaaagagattcttggaatctcttcctattcctttcctattcaaggaaaggtcttcagagcctgccatttcaaagaatggtattaattcttgggaagactctggtagatttcattaacacctgcaaattccaccctctgcctcaaggaaagtaataaaagtcctctatcctgttggctgaaagcagtggaaagttcttcaattttatcattggctcctaataggagtaatcatgcttcagggtctgtatctctgtgtcccatagacaactaaagcttttgatcttagggttcatagaactgagaagaacgcagtaagtcttttgcatttcagaaaaataaaagtatgaaaccttttgataagtttccatctcttgttatactaacattacttctcatattttcaagtaaaaaaaaaactcaaaatcagggtgggctaagtgataagagcaatcacttctgatttggtgaagatactagaagaggattaaaggatatgtacagatatgtgtatattaccaactgaggaaatggaagcatgagcagaaaagcgaaacagaaccctaagtgaggtgaacatagaaagtaaacgtcctaaagtcataaacagagacaaaacctcactgaaagttttcacttataatatttttaaacagatttgacatttctttccatttattttctgtaggtatagaatattttataactgacctatttataatgggactaccaccaaatatccatttttaaaatgctctctccatagcatgaatgtcttataaaatctagtctctttcttaatattgttaatacagaagcttctccttcaaagattgaaggtttttttctgcttttggaaataatttgagaaataacatagtactcacagccacttgccaacctgaaaatgttcagcatttatgtaacacttgaccttttcaaaaataaagtacataactcaatcttttcaactactttgccatgagatgtccagaacatttctgtgtagtaaaatagatttcctaggttactctgattttgctgacaaagattttaagtattctactacttaagataacataatctataaacacactttagtgttcatagacatagcagcacatcaagagcaccaaaaacgctaataaataagagagaggcctgacattatgcatcctattaaggatctctgattttccacagaagatatcaagtaccatatattacatcaaattatctgaaaacctgtatattaaaaattggtaaagtttatttctttcttaattcttaaataagcctgtgaagagacattataatatgtccttctagaaccccagttcatcgtgtgtatctcctaagtgggtgctatccactgtgtagactgtgctttaaattataatgctgtcttcatcatctaaattcttttagaatttaccaccagaactgaagtatagtgaattaagtgtttaccatttgtgagggatggtgtaagcactccactaaatcatctaatttaacctcacaacataagggatgattattgtctacattttactatgaggagacctgattcataaaggttagaaacttgcccaaggtcgaagagctaataaaaagcagagatgggaactgaattcagtatctgtctcacgaaatcctgaatattaacttgttgccagacttttttgtaataactcaaggggaagaaacatttcccagagatagctagatttataaaatttaatttaaaaatcaaaatataataatgtgttatattttatgtgaatgtgatcattctaagtctctcatacactcacagaattgtggatagatttctttgattcatccagtctttttcacccttagaaatttctgtgaccaattttatatgtttataatatgattgtatatggcatataatttttgcattctaaacagatagcttgtctatataaaaataaaaaatgaactaccataagtttcattagcacaatgccttaaaatttactcacattttaaattttaaatcagtacataaaatatagatacaatgaaatatgcagcaaatattactgggattttgttggtatataatcatacccgaaacctgtcaaaacttaaaacacacccattggtacatttcaacttatttgttctactttggaaagcagaaatggaaagaaacagaataaacagaaatacctttttgtcacatagtgagataatcaatactatgtttaaaaacaaagtttctttatattttcaaaatagcctctagtggaatcagctaccatattcttgatttgcataatacttataaatttcctacaaactcagtacatattctatttggaagtttttatatataggctttatattacactaaaaaggtcatcaaattattgccacgtccataaattaaaatatgttaaactccaaatatgaaagtacggcagctcttcaaaaaccttaacataaaggtaaattaaaattatgcaaattgagtagaaaactcatgcagaaactgtaaatctggaatagggaagccatttaaggtaaaagagaaatcgtcacaagtatgcttagaatttcctgatttagaaatagtgggacaaaatacaatcctacctatcaagcttttcagataataacattgtgcctaggcctgaaagtacatgcatgacatttgtttgaaaggattgtgattgccttgtaaacttcttttacaaatttattaacacgggttgttccgtatagttggccaacattgcttatttcttccactgccctacaacaaccataaactcccaattattctgggagtagtttatcagagtacagattatctggaggtgttatttctctttcatttggcctttcacagctcattagtacctcaacaagaaagttaaggcaaaggatggaaaggctgcagaatttctaaacaaataaatttgctccttgtcagcagcatatacagaacagcatttagagatatcacacaaaataactaaaatgggataaacaaagatatttaatgtatactgtggcaattttccttgagtgatttttccctctgtactgtcaaaaatattgactgaattgactgtaggttttggcatccaacagacctcaaagtcctttgtttttagcatgtaattgaccatctttagcgatatcacctgccattgagtaatgcattacatttgttgccaatatattgactatttttcaatgtgaagacaaaaactgaaaaccaaatttgcaaaggaagattgatgataatcttgagtggagtctactagaaagcttgtttgattttaggcttgccaatgcattcgatgccatcagcacagggatatctatccttgccttgaggagaaataagggaatcagaaaattaaggctcttttagtatctactcattagaggtgatatatccttaatcatgaaaataataatgtgttatatccattattattttgctttttaataagaatgtaagatatccataatcaattggtaaacttatctttgtctagcctatctactggcaattgaacaaataataaaaaaacttcaaatagataattttttacaaaattattttaattacagacttgccaggtagaagagcaactaacaaaagagcctttatacattcaatacatcataacttcatttattttatagagaagagcttgaaaatcatatggaattctggctctgtcacttagtacaaatagtgttgctttaacaaatatttattaagcaactacaaaggaccaggcactattttaggcaatgatgatatagccatatacaaaacagacagaaatctaagttctcattcagtgaatcatgtcactgaaggcatgctaatcaagagaaataagtaaaatagaaggatgtaagtgttatggagaaaaggaagcaaggaaggggaattgaaagtactagggaaaatatcattgagaaaaagatttaaagatatgagagagtaagtcatgtgagtatgtggaggaaatgtgttccaggtagaggcatctatgactgcggtggaatgagagacggtaacaacggtggaaaaggaagccagagaagaaacatagagaaaggaggaggtgattgtgcatgggcttataaaacagcaggactgcattttactgaatgtctggcaaggcatgggaaggttttcagcagaagagtgatgtgatttgccttacgttttaacaagaccatctggcagacaaaatggattacaggtaaggcaaggccaaagcaggcaggcttgtttaaaaggctatttcactaatttagaccagaggtgatggtggtggccatgtaagtagtcagaagtgatcagattctggatatatacctggttaaggtggacctggcataggtttttttttttttttttttttgagatggagtctcgctctgtcacccaggctggagtgcagtagcgcgatatccgctcactacaagctccgcctcccgggttcacgccattctcctgcctcagcctcccgagtagctgggactacaggcacctgccaccacggccggcaaattttttgtatttttagtagagacggggtttcaccgtgttagccaggatggtctcgatctcctgacctcgtgatccgcccgcctcggcctctcaaagtgctgggattacaggcgtgagccaccgcatccggccaaacctggcatagttttctaatcaacaacatcaggtgtgagaaagaacaagactaagtttgactcaaagatgttcatttggggcaactggaaggctatagtgaaaccttactgacacaggaaaaactattgacgaagcagatgtgggtgttagtaaatttagttttacatagggtaaatttgaattgactaggaatgtataaaaagttgtgtatctaagtttggagtttggcagaaagctctgagctgggggtaaacattgggaggcatcaacttacagacagtatttgatgccaggaggctagataagatcatcgagaaaatgaatgtggtctaagaaccaacccctggttactgtcatatcaggaatttgtgttgatggggaagaaccagcaaattaaaatcaaagcagatgctagaaaaacaggaagaaaacctggaatgtgtggtgccttagaaatcaaagaggggaaagtaaatgcatgtctcaaatcctcctacatttacttaagttacttaatttaggtagtacatataaggaatctcacattgtggctagcatactgtaaaaacttaataaatgtttgttgaacaaattatgtgtcatttcataacccaaccaacatatatcaggatactggttgtgatatatgcagaatacatttggcaattgagtgttaccaatatattatcaaacatgctagagaagtgtagtgtaccgagaattaagaatatgggctgtggaatcaaaatatctagactcaaattcttttctgtaccactgaaccttagtgttctcgtctgaaaatgggaataacaagaatataaactcctaatgttggtaagctaagttaaacatgttaataatatacatacagcatggaagaacctggtcttcagtaaatcctcaacaaattttgttattgtgccaattaaggcacacttaagaagcaatgtcttatgtattcaattaatactaaaatgagcacatattgtggattcatgtatcaactatgtattaatcactcacttagatcacaatggatataaagaataaaagagctgccctcaaggaaatcatagtccagtggaggaaacctacaagtaagcaaaaaatatatgtgctctcataagaacacgtccaagaagaaatggaagcattgaaaagggaagcgaaatatgaactgagaagtaggaatttttacacactactaagaccttgtcaagttagtgtcttcccttatggcgccatgtctaatacactcagcgttgtttcatcaacgtgttttcccggtaatcttttgggggaattgacagtcaaaccatgaacattggtactacatttatatttatgaaagatcattctggatgcagtgtggagaatgatctatggaagatgagggcagcaagaccagttagatatccagtgaatgacagtatgtaatagtcagaacctgactgctgccataagaactcaagaactgttgaaaaaatgaattgatgagatatatactgaggacttcaacaaaacagaagtagggaaagagggggagatgacagacttctgacatatatgatcttagagtgtattggacgtgggcactataaatatgacaaggacagtacagttgttgagaatgattcctaggtgtctttttttattattatacttcaagttctgggatacatgtgcagaacgtgcaggtttgttacataaatatacatgtgctatagtggtttgctgcacccatcaacccgtcatccaggttttaagccctgcatgcattaggtatttatcctaatgctctccctacccttgccctccactcccagacaggcgatggtgtgtgatgttcccctccctgtgtccatgtgttctcattgttcaactcccacttatgagtgagaacatgcggtatttggttttctgttcctgggttagtttgcttagaatgatggtttccagctccatccatgtccctgcaaaggacaagaactcattctattttatggtcgcatagtattccatgtatatgtgccacattttctttatccagtctatcattgatgggaatggtcaggagttcgagaccagcatggccaacatggtgaaaccctgtctctactaaaataacaaaaattagccaggcgtggtggtgggtgcctgtagtcccatctacttgggaggctgaggaagtagaatcgttgaacctgggaggcaggggtgcagtgagctgaaattgggtcaatgaactctaacctgggcaacagagcaataatctgtctccaaaaaaaaaaaaacagcaagcaaagacaaagcaaggttttgtgaggcaaggaattcaaaaccaccatatgacccaagaatccctccttctgggcatatacacaaaggaaaaaataacacaaccttgtaaagatatccgggcttctatgctcattgaagcattgttcacagtagccaagatatggaaacaacgtttaagtatccatggataaatgattaaagacattatggcatatatgcaattgaatattattcagtccttaaaaaaagaatgaaatcttgccatttgctacaacatggatgagcctagaatacattacactaagaatttaaaccttggatgacatcaatgagctctagaactcctcatgcgtagaaatcaccctacatttgactttcagtttatttaacaggtaacaacttctggttattactggcccggaagacgtttgtagtaaacagaagagacaactgtctctgtcctcatggaactcacacttttgtgtgattatacaagcaataaataaataaattatattgaacaaaaaaaagtttgttccaaattatatttgcagccactttatgaataaattgttgagcttagtgctgtgtgacacgataaattggaggattaagaaatgcattaagcaacaccaacaagggagtacaaatattatatttaaccatcatatttcattggaccttaagtgccattcttctagttttatggaggaaatgtattaggacatgataatcatctaatactgcactaaatattgtagtttactgttactgaaagcataagatggaaatcctaggggtcaacattatgtgacagaaaagatcacatgtataatatttgtcttttctacattttgtctatttgacactgggtcggctacaccttcgcttaaaagttctcaccattctctgcttttgtgttttttttttttttttttccagttttctactcaagtcagataatggtaaatctaattgcatcttgatgagctacttaaaaatacccttaaggctgggcactgtggctcatgcctgtaatcccagcactttgggaggccgaggcgggcggatcacctaaggtcaggagttcaagaccagcctggccaacatagcaaaaccttgtcactatttaaaaaaaaaaaaatacaaaaattagtcgggcatggtggcaggtgcctgtaatcccagctactagtgaggctaaggcagaagaatcgcttgagcccaggaggcggaggttgcagtgagccgagattgtgccactgcatgccagcctggcgacagagggagactccatctcgggaaaaaaaaaaaagtacacttaaatgacatacatttcatctcagagcctaagtataatttgaagcatttcaaattgctggcccatttgcttatcaaatcttgttatatttttgaatcacatttcattgttaaacaccctcagtgtatacactcatatgtccctatgcctatcaactttgtggactgagacaagaatattttttttacctcaagtgtaagaatgtaatcactatcaaaactcagactatttactgatgtttttctaaatggaatagtctgttgcattattcagtcatgagaaatcatgtttttgacagggcttgtttctcaagttggcttaaaaggttccttcgcatctctgcattattcacacattgctgtagaaggtgctaaaaacttggcatcaggagacagagtcctactgatcagcaggttatcatatgaatagtggaattccagcagcaagtgttttaaaacaaaatgccgcctgatacttattttatcatgttttataaaatcaaatcatgttaaactgttccagtgatgtcatggtctctgctctcttccctatgccatcttgctctctgataaaacttgaacttgaaagattttttttttttaatgaagggaggaaaatacagagactacggcattgaagagaattaagtaggaatcaatactaataataatcacttactaaaaatgggagtatgttagttaaatactaatgggattaaaacttcttatcgaagctgtatgctgaatgttcattacatttttctggacatttttgtcctgaaaaatcaacatttataggttgataccacatattttatatagcacattgtatgttatacacaggaatttacggtgtactgtagattcctaccacagagtgtatcatcaaaattaggagtttatcagaactcttaattctctcccaatctgaaatattaacatcattcttctatgaactatcccatctcctccttactttcatcactgaacctcagaattgattaaactttcctccttccagtttcccataatcagccgtaattctatgtattatttcttgttttccacacttatacttaaaaatccctctcacagcacacaagtatacttctaaaacagtagatccagttgcccttcccctacctgcatcctcctcaattcatttgcagcactgtttaacataactaccttctttaaagtctttttaaatatctgttatgtgatggtactttcctaaggaaactcttaaatcgtacctaactatgtctcccacctctagttccctacagatagatagatcgatcaacaaaacaatcaatcaaatattctgtccttgaacctcttcaaatttgattgtactttttttctctgtgaaatttcatgtactttttgggattactctgttatctctctccaccctagcccctgcaatgcgattctatcactggtcttaactgatctgttgataataaaccctgatttccaaatacagttagcttattctggaggcaaccttgacactttcaactcagcatggccctttttggttttttttggcaatccttcctaaaggcaaagtgcctctccattcagcttcataagtcccagggttgaaacacatgacttgttattcaaaacctgccaatgcccttctcttgcctactgaataaaatgtatctccttgagcatgatatgcaaaatcctccacaatgtgtccttcaacctcattttccagccgcctctcctactcctcctcccctaaccatatgccctacacacgaaacgaacagtcacaaaatgaactgacgattcgtgcttctttctcatttagctccacaaagtgaagtaatatttctatgggatgatctccttataaaaatcatacttgactatcaaggctcatcattcagttataccttctgctacctgctaagccaagatttatgaagctataatttatggtcccagaggatttatatgaaaagttattatacttcctatctctactgtgtcttaaagcagctgtaagagtgtctgtctcctctctagtgcataaagaacctgaggacaagtcaagtaacacccagtaattaacacaaattagatgatcagtaagtacttgacagattaaattactagtgtttgaccttcacatatgacactattatgtatattttaaaagtatcactgttgattagaaataaattttaacacaaaggccagaagacataacttagaaatcataggtttaggaattcaagatgcctaggtctattttactctgcctcttactagcacaaggacccttcagtaagtcttaatcttaatctgtatagtgggaagcttgattggtggtaaacctcataaatattgccattcaagtaactgccacatgctcctgccatattgtaagtgtacaatgaatgctacctaaattatcataaaacagtcaacagtgataacatgtatatgtgacgatttttgcaaaccttgttctatttggaattttaagaaagtaagcaacatgaaaccactggttgagaagatgtaattatttgtaaacaaagacctttatttttagtaaagattcatcagtgcaacctgtcagaattttctacttcaaatgatttaaaaataaatgattcaaaagtacagtttttttcctgctatggcagtagtgaacactgtactaatttgaacagattctgtgaatgccaaaagcattgtaatgttgacaaatgtgtacttctaaacagtgaggatgtgtgtgtgtgtgtgagtgggagaataatatacatataaagtacattccccagggtttgcttaggttttgatgacctaacccaaagcatcgcaaagatccaccaatatagatgacagtttatgttggaacacaatttaagaatatatactcagctacaagtgggtcggtacaaattgttaatatctcaatgtcaatactactcatgagtaaattaccaccaagataattatacatatatctctcaccttggatctttcagaaatttggcctaggtacttatataatgttctgaataatgtatctctctccattatttagtaaattatgtcagattcataaacatttctcaattaccagacatcaaactgttttcaacaaacttcttattccaattaactataacttcgatttttaaatttatgtacatacacacacacactctgagaaaaagagacagagttcaccaggttcccatttatcttcaaaattgaccctatataaatgttattttaaaacaaaagataaaaccataatcaggatactattattattaacaaatcagattacttggctatttctgcatatattttactctctgataaaaatattataatcattttctgccaaatataatctgcacctctgctaattactcattttccattaaaatgtaaaagtcaataaaacttatttagaaaaatggaaaatcatacatcaggttgacctgggaggctcccctattcttgtcctttacaaagtaatctaaccagataaagagcttcattttattcagcttattaaaccctatggtttgtttctgtaaattctatagtacacatttaagaccagtcatctgtgagaagaaaatgtaataccaccaaatttaaataacaatccaaactatgaaagtagatgcatatactttttatatgcttatgctttatataagctgtatagtatgtaactaactcaagtgggctcatccatcattggtttattgtttctctgaaaaaacacccctcaaggtctttatatgataaaatgaaaaatgacagaaaagaaaaatatgatgatattggaaataagcacattctgaaagccaatttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatgtgtgtgtatgtgtatgtgtgtgcatgtgcgtgtgtgtgtctgcatatttcaagttttcttgagaagagttttccattattgtaccaaacatcattctagtttatatggactttggtatcaggaagtgggttgttgaaagttaatagatcctataatgtggaacaggctgaattatgagaagacaaggatgataaacctcccccaccccaactcaaaatgatacttggtacatgattaaaaaacagttgattaaacaatggtctattttatcctaagtcatgtgccttacgagtaccaacactattaggagatttgatagaaacaaaaatgttgccacctactggcctctttaaaccaagaaagaaaaaacctcatgctaatggttacttgtttttgaagtacagaaaaaaaagaaaatatagctttgtctgaagaagccctctctgcctgtggcttataacgtgaacgccttgagaggctgataatttggagcctgatatgagtggaaaagccaatttgtatttttactccaaatcgaatgtttgtatgaacagagacaggagaggcagaatgtaagacttaagtactaaaaaaaatcaactatagtgcttccctaaagcacttttgtgacaaagtagacgatccctcctatcatgaagaagcagcttctatgtaatctatacttcaaagatatactcaaagattggctatgccctctaccccaaccctgtgctgcaaattttctcagtcaggggattgtgcaaagcacagaggcctcttaaagatgtcaaaagaggttaacatttgaagcctaaaaccaaatcatagaatttgggttactgggtcatggaattgataagaacaaatactgaaagcctataaatagtaaacaaatctgattgccaaagaaaccccaggtctaactaaaaacaccttgttatcactcaaacctagggcaagcaccaggacttttaaacaacacaataagtagaataataaagtaacacaaaaccccaaaatatgtcaacttcagatatcatgatgaagacaagtatttagcaaaatttataatgaacagaaggaaaaatcaccaggaaggctctgaaagtgcaggatataatatctgtttcaatttggtttcttttataaatttagtttagttttaatcaggatgtgcccttctaactttttacttagcagtactggacatcaaattttttcacttagtcatagtccactggatggatcataaagactaattgaaagggactgctaatcacccagatatcccaaccttggagctgaatgcaatcactggataatgttttatacttgctctttttgaggagtctgagcatctttgaaagtgaatatatgctatgaagggtgtatagcaatgttggatattcaaagaggaggactgtagtaagcactgcaattatacagtcaatatcctttcttctactctctgatggcacagtagcctggtgatttggaaagcattgttattactctcagttctagatatgcgctcggtttttgtgcaagccaagtgggatactgctatgtactttgcttcagggaggtgttcaggccaggcatatgatctaagagtttccaagcagagagaaactcagaccttttgtttcctatttgggtaaagatatattctttacatttagctgtaaacaagggaaaagagtttccaagatctgctgagggaagccggtctgtatgagttcgaaaagttatggagggtaggcttagattaacagagaagcaaagacttctccttaaatccataataaaactctgtattaaacccttgagcaaaccttgaactctttacttagccaacaaattctctttgtatcttgagtacatttgaaaccaagcatcctaaataatacaggatataatagactttaatgttcttcatcaacttaataaatccttaaataatcaacaatcattctaatatgtacttatatcatcttcagtgccgaatgttctgatttcaaattcaatgttcaattgctcagttcaccaaatctagttaattgctgttagtcaaaaagcattctcattaatgacactgatgctattatcaataaaatggagtcattttgaattggtttgcttattcatcaaatggaatttttagaaaggatgtattatcttactacaactaggatgccaaatgggaatttaatgcaccattttttcacaggcttgctataaatcagaatctttaaaacatttctctccaattctctctcttccactcctgaaagagatggtaatatcatctgaatctctttcaaggaaaaaagattaatgaagtcatctgttgatagatttcacagcaattattcttcctcattaccagttcccaaacttcacctttcattttataaagtaacctttattttaaacctgcctgtattttaccttcttattttctggttgcctgatttataatttgtcattatattgcttatatattcatccacttttagtaaatcatgaagtgtgtgcataagtgtgtttatgaaaacccaacctttcctctaatgatagcttcataaagctctatgttgtgtcattttagcatacaggttaatagaatcaattctggaatgagattgtgtgtgtgttcaaatcctggcacagctgcttttcatgtgcataactgtgcacagatttcttaaccagcttatcaattttctcaagtgtaaaatggatatattaacagaatcttctcaatagggttgttataaacattgaattaatgtatgaaaagtgtttacagcaatgtttgttatataatgattgtccaatatcagttagtaatttttgtgacattattcatcatcacagacattatctaagagtaactggttcattatctaagatcaacactcaggaaggagcttaggctaataaaatgattcagagcccagaaattggaaaacttgggttgagtgacatacctatcagtttctaaccatactactttggtcaactcattcaagatatataaggttgtttttagttgacagagttaaaaatttcatcttttatctcacaagtaagctcactggggcataaataatacaaagcacgtaaaagggatatgaacattttataaggtgtgaagaatccctcttatacataagagcataacacattcttcagttgaagcaatagagccctttcactacctgttctgggaatggctcaacttatgtagcacttgctcttgtctttccacgaacacaaagtttgcagctgaaacatgaaacctctttcctgcttcccaatctaccagattttcaacatggataatataacataaaggacttatctgtctgtaccatagaaataagtagtattttgcctggctttccaagtcctcagagtctcaccataccctatttttctcagaatttcattgccattttggggcaatgaattcttttgagaatatgattgaaattctggatcctttacactatgtgtacacaaaaatgtttggagattgtgttagcgggattgtggacgctattatgcacatttaacaaactcttagggttttataaactgtgatgattgttataccattttatttatctgcaccggcttatcattacaagctcagttaacattctccatccttcagtaattagtaatgttagcccgtgtctttaaaaaacaaaacaaacacatatgtattgaggtatgatgtcctctgattatatatcttaatgtagtattttattttatagtgtactatttaccagttctgccagtgttaatcattgtccgtaattagaatattatttcctatcttcagttttctctattaaattgtgatttttgaagaccatgtcactattttcctgattttcatttattgaaattgaaaaatatatgtaagagtttttcatttattgacatttaaaaatatatgtaaaagagttttacatttttaaattacatgttttatttatttttgcatgttttaaaatatgtaatttcactgacaaatgaaaattcagagaaatgaaactcctataaaattaattgaaaagagtctagtgtaaaatattctgaatataacctttgttctaagtacatatatagatgtataaccacacaaataatttattttttcaaaaccagtcacaatgttgtcttagctacattttcagttatttaatgtattgtaaaaatatgccatgcaattaaactcttttatatcttaactttgtagtggcttcatggtattatatcatttggagatataatttatttaaagaaactaacagtatattcacatgtgcatatttccactgaacacacattaatttcattaacaaaaagaaatacaagaccaaagaagttgacctctaaactatcttcctatacttctaatgtgaacactattcaatcatctcataatttaaattaaaatgaaataaactacataggcactggaattttgtttctttctacctcttaaaatttggaatgctcccttaaaattaatagattccaataacttacaagaaaatacccacctttacacaaagttactataaaaatccttcatgtgtgattaaaaaataatatttacatgtttactttgtgatcagatttatacttagcagctcaatttttagaataatgatatgaggaaataactattatgaagccattttatcaaaaaaagagcaaaatatcaggatctcaaagagctattagcactccagtgctcattatagcacgattaaaaatagtcacgatgtgggaacaacgtaaatgcccgatagctgaatggataaagaagatgtggtaaatacatacaatggaattttattcagtctttaaaaagaaggaaaacttgcaatatgtgacaagttggatgaaccttgaaggtatattgtaaatgaaaaaagctagacacagaaatacaaatacttcatgattctactcacaccaggtatctaaaattgccaaactcagagaatcagagattagagtggtggcttttagaggctgaaaggaggagaaaatggggaaatgctaattaatgggcataaaattttcatcatgcaagatgaataaattctaaagatctgctacacaacgttgtctctaataatactgtattgtacacttaaaatggttatttgataaatctgttgagtgtccttacagaagaaaagaacagttttaacaaatgttttatgtatcacaaagcagatgatgatgccctatggtgtttcttgctaacaattttcaacacattttttatgtaaggtgaaatgtcaactaaaatatccaaatagacaaaagtgagcacaatgtgcagtaatataccttaagtcacacatttagtaagtagcagaaccagaattacagataaaagtcagactgattagcaactgtgtttgcgtgtccgtgtgtgtgtgtgtgtgtgtgttgtgttgtgtatgtgtgtatgggtgggtgcctacatgcttagtatattttaatctcctaaaatcaaagggcaactgtccaggccaatatgagtacattctacgaaacaagaataaacactaacatgtgatcccttctctactcctccctcattctctcacagtcagagttatattatctttccctgccccatgaccaaaaaagaatctgtgcttttcacattctgtcctttgtgaagagaaaatttgactggtcaacataaacttacgcacgttgtcactcctgtgaataattctaataaataaatgactaggaactttgactccctccttacaactttggcaataaaacagatttttaaacatataatttgcataagttaatcatgtaaatataaaaatttaaacataaaacaaatgtactgaaagaaaaaacaactattatgaggtcatgtataacaataaaatcaccactgataaacctaacacactaaaaagtaagataagtctcaaagtcactggaaaaaaatatgtaatgaaaaatttaaagttataaatcttacaaaaatataggacagtgcctaattatctgagtgattaatattgctaggtatgctaggggagatcagccaatgcttagtccagtgttatagttgagccttttgtatttctacagttatatgttttgcttcatgatatggtataattggagttattccacaggggaagttaatagaaggaaagaataaagatcagaacaaaagtaaataaaatagaaactagaaaaacaatagaaaatagtaacaacgaggttttggtttttttttttgtgaaaagatagactggcttgttcttgacatttactgattccacaatatgcaattcagatttagtaaagaacatttactgaatggaaattgtcacccaactctttctggttttttgtccttgttaagtgaatgaacaaaattggcgaaaaattttatgtccgaaagttcttaaagtctaggggaaacatttcttatgaactaaatgtaattcaaaaacatttaacagaaggaatcttaatgtcaggcagtgagaaaaaatagaaagtcaaagatctctaaagatgggggtgatgaaaaagaaaaggaactgccttttatgaaaatggaaatactattttgtttactggggggtagatttaggtaaataataaaatagaagttttaattggcaaagcgaaaaacacttaaaacatgctgaaaaagaccacgtcaatcaattttactcactttaaacatgtttttttcattcccttttcacagtatactgagactgaaactgacacaagaaacgttcactaaattgttgatgttcgtttcgctctaatatttgtacttttttttttttttttttttttttttttttgagacggagtcttactctgtcacccaggctggagtgcagtggcgcgatctcggctcactgcaacctccgcctctggggttcaagcgattctcctgcctcagcctctgagtagctgggaatacaggcatgtgccaccacacctggctgatttttgtatttttacttgagacggggcttcaccatgttggtcaggctggtctcgaactcctgaactcatgatccgcctgcttcggcctcccagagtgctgggattacaggcatgagccaccgtgcctggcctaaatttttgtactcttaaaaaactaagctatcatattgattatgaccatgacacatatgaccatgaaaatatttttctaatatttaacgtaacgtttagaaacatcactaagaacttcaaatacaatcaaaatactgactttgaatattgtttttttcaaaggcctgacgtttttgtccaacacaaataagactgtcttcacaactggtcctcaggcactgagtagagtaagtttctccaagccaaaggctgtctataaatcttaatctacttttgtacactactaaaatttcctctcatggaatggtgaaaaatctccaataattcttatgctttaatttattgagaaaaacaattatttcattcaaaattaggtattacatctcaaattatgaatgcccaatatttgttaaaagactcatatatttaatattacttcaaaaattagtgaaaactttatataagccaatattttcaaaatgtacttaaaaatagaaatttcattttgagcctcaacattgtttgctgtctctctccccccatcaactctccttccacccaccccaacctttctccccagcacacacacacagaaacacatacacacacacacacagtcaaagttgttttgaacagaaaaccctcaggctacgccccttatatttgagacgggagtgggggtaacagtccacagctgctcatctacttctggtaccttctctagccttatttatttcctagttacatattttacatcacttttcactgatttcttctccatacattttctacctttgaccagtaagtgatagttttcctctttatctaatctttttgctattaggcgataaagaatcttagagcagcaaagattccaaaatatctgtttcgtccatctcttaagcatagggttatttccatggctttagtaataccatttattgaaatcatgtcccacctaaagtattttcattcttttcttatctaagcctcgtaaaaagctctgttcaagatgaacttactctatggaaatcttcctgagtacgagtcgatggaccattgtaggatgcataaactgccgattcttggatcccattcatcacgctagtaataagccttatatatccatatttgtacgatctctccaatcactgaaattagtttggaaaaatcaaacatgtgtttgaaatacaaggtagcatatcccaccttgtattactcattcttttatacgtaactcttctattacgatgaggttgatgggattaataattcatagtaagagaaggaagatgacgtaaaactgtgctgcagcagggtttatattgcaggacctgcttcaaaaccctgaacaatatattagattcacgggcagctgctcccttaagtattgctgttcactcaactcttagaatatacaatacaatcgcaaactggggcatataaaagaaacgtgatgctttcattcatttgatcaatatgctttatgtacctagtatatattctagtccttttcctcttggagtttttactcattagggaaaaacgacctgcaaatatcgtaatgtcagtagtgataactacaatgaggaaaaaaattaaagctttgaaagaagacagaacaatggtagtggcatatcaaatagggtagtcagaaaagatctctttgcagtctaaggtaaaggaagtgcgccatatgaataactgggggaaaaacccttccaggaagagggagatacatgtgtaaagtcactgaactcaaagtatgcttggcgtatttgatgccaagctagtaggccagtgtatctggagctgagaaatggggttaagggtaggaaagaaggtaggatacctatagggaacaaatcacgatggtgttttggattttcttccgagtgtaaagtgaaattatttcaggatttagaactactctcaacatcttctctacttactcagtttgtaaattccttaagggcaataatatggccatatatgttccccatgcttggttcactgtctctcattccataatagttaccactattccacaagacccatcgattagaattatggatttaaggcttgcaaaggagaagaaagctcatcttagacagctatatggttccagtacatagtaagtgaacatattaataagccatgtgtcccgtgaccgactgccttttacaaccagtctcattaggtagtctatacttaaacactactctgacagagggctcactatcccccaaagccttttattgcattttgagacatttctattagcgagtattcaaatatcacatatttgaccccatgaattttagcaagttaacttagtttatgatttcaattttggaatttaattttttatgcttgaagagttcatatcaaaaaaaacaaattttgagagcatggccatgtttttatttcatagttcattttgtccttagatgtttctgacaacataaatttagcagtgtagcagttattaacaccattcatatttatttccagctttctacctttgagacatgtaatacgaatatatttcttagttctaagttgggtgagaccatgtaactagttgtgctcgtgagttgtgaactgaagcagatatgtcacttccagttcaagcaattaattgccagcacaagacctttcagaattttctttccctttgcggagtgactgggagtatcctagatagtagctgtttcatcaggctgggtttccaaatgaccacaatgaatagcgttcccttgctgattcacagtgcacattggaatgaaaaagttattataacatagtgaaatttaataaccagatctagaatgactggtttagatggcacttaataaacattaagtgactagtaacacattctaacagcagtctttaacctgcatattgtgatacattagtaaatctccaaaccacaattgggttatcatggtaaagagctttatggtagtttctaggacatactaattactcaataattttctattgaaagaaggagtggcgattcctcagggatctagaactagaaataccacttgacccagccatcacattactgggtatatacccaaaggattataaatcatgctgctataaagatacatgtacacgtatgcttattgtggcactactcacaatagcaaagacttggaatcaacccaaatgtccaacaatgatagactggattaagaaaatgtgccacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaatcgaacaatgagaacacatggacacaggaaggggaacatcacacactgggtcccgtagtggggtggggggagggggaagggatagcattaggagatatacctaatgttaaatgatgagttaatgggtgcagcacaccaacatggcacatgtatacatatgtaactaacctgcacattgtgcacatgtaccctaaaagtataataaaaaaaaaaagaaagaaagaaggagtgaatgtaaccattcacctaacaagaagtttttgagacatattgcctcaatatttcaagggccactgagtaataatgacttatttgtttaaaaattaagacggtaaaaatagtaagttgttaaatttccaatgaaaaaaattgcaccatagaagcaaaagtgaaatgttatagcacatacaaaacacacacacacacacatacatacacacacacacacacacacacacacacacacacacagtgtgtatacataatggatttagagttctagttatgaggatgagactagggaaataggcacagagataaagtgctgttagagacaacccatatgtataacttcgaatagaacatactccctatgtaagtgtttagtattattggtagatatgtgtattgctgtatgtatatacccacacacacacatatatatgcacacgtaacacacagatatatactctatttgaaaactttgcttataatctaaccatgtatcagtgctatctttacagcatggtattaagtatataactatagcatgaattttaaagatttcatgatattgcattaaaaatatttaccctaagttttattaatcctatggtgatcactattcaagtgtttattaaactttccctctttgaaaacctgttttaactatgtcttacatcatttcatttaccagattattactcctaaatttaaattttgtgattaaaaaattatgcaccagaaggacagcatcaatttattctgtcataagccctcttacaacttttgatgtttcctgtttctttatgttctgcaaaattatcagtattatcactgtttcaatctgcctatctggtagttaaaaataatttgattgtttatattatatttttttattaagtagatggtatgtctttttacatacttaatgatatatgggctttttcgcttttgtcattttctggctcatgttctttatgaattttcctattggggcattctagttttacttattgatttatcagcattatttatatatgagggctatcaatccttcgtatgttataaatgttactaataattttcccaactttatatttgacttctaactttccttagagtctttcttaaaagcatcataaccaatacatgatgcaagaattgccatactaaattcctttattgactccataaataattaactataatcatgctctatgaagcaatagaaatgttaagatttttaagagcttataaaaactttatttcacatttattcctggcttctaggatcaagtggccaataagcaattattaaattaatggtaatactacagtgcttccggcatacttgttcctgaactatttgaggtaccaaatagttaaaatgactttaatcacctagctcacctgaaatttaaattataaagtagaagtagaagaatccacgggctaatcttatttctcattccattaatgatctaaatttcttcttgaaatgactttttcaggtattataaagtaaatttgaatgtttcagaaagaggactacatatcttaggaagcagataattgccactggatttagcaatctgacacacaatatagaaatttctaattaaagttctatttttataatgctaatctttcagccaaaaatttccttgggacatgttataatgaagataaaatgtactaagattttaaattgaccagagttcccagagacacctaataaacattttcataaatattcactataagtaagttttattgtgaagtaatcccattgttatacatacctctcatcattggcatcattacactttaaataagttacctaatagaagtaagtatttaaaatgctaagcttgaaaatctggatttgctacacataaaagaggaacatgactttatgtagctgaattggtatgcagatgatctagaaatgaggagtttcataacgataccatcaactcatcattaatccttccaaagatagtttatttccccaaagatttaattgatagcattctcataatttaaaaaatgactgtatttctattaaactttataatgaacaaaatatgtgaccgttaattatgtgttgattttaaagtcactctaattattactaaataaggtatctcttcaaaagaattaatatttttctttacattgacatgcttaagggggtaaactcttagtgaaaacaaaaaagtttgctagtagatttgagacccacatggatttaacacatgtatgacataataggaggctctgtgttaatctacaagtttggtaacaagtttatgttgattaaccaagcattattacattttttcactgatattatttgtagataaagaccacaatatgcaaggatatgtgctgccagaattctatagcagggattaaaattaggcatgggtatccactaattatacattttaaggaatatatctgtatggccgggcacaatggctcacatctgtaatcacagaactttggatggccaaggcggctggatcacctgaggtcaagagttcgagaccagcctggccaaaatggggaaacctcgtctctactgaaaaatacaaaaattagctgggtgtggtggcaggcacctgtaataccagctactcaggaggctgaggcaggagagttgcttgaacccaggaggcagaggttgcattgagccaagatcgtgccagtgcacttcagccggggcaacagagcaaaaactccatctcaaaaaaaaaaaaaaaaaaaaaaagaaaagaaaagaaaagaaagaaatgtatctaagttttcattttcaatcatggttgtcatgtatcttaattatgatgttacaacactttgaatatagtttcattaaaatataaggttaataatttaaagagaaaagattaaaaatattaaaatattttctgaaaacaaaatagattgtaataaaattaatgcaaaaaagaaaatcaaattacttaatgaatgtagaaactagagatcgccctacagaaaatgtgacagtgtgatgaattagcttaaaataattataatccttaagaagacatcatgtttaacaaaattcaggatatcaggatcctagaccaaatatttctgctctgtaatcttaggtacatgacttagcatatctcagcttgagtgtcttcacctgtaaaatgaaaggtgtagaggtttcagtgtctacttaatattcttggtattaaattacacatacaaattatttccaaatggatttgaaatttcatttgtgctagaaagcaattaagtggccatttcggctcctactctgtgacacttatgtgcaaggacattctcaaacttcttaatcaggagcctggatatttgaagatctgtacaagcttacctaaaacaagtacagtcatcagtaagtagagtgcactttattgaacacctgttaggcaccatgctagccacatttcccaactaacctggattcttcagaagaatcttgtaagttctgacagattgtatttttttaagatggatacaatatgtttcatcttacatgttattcttcggatgtaacactgatacttctccatcaagagttgggtttatgtttctgccccttgactaggatggacccctgactatggaagaagttatactatgtgacttccaagactaagtcacaaaaggcaatagagtttctgcttggtactctttgggtcacttactcttggaatccagccagcatttagtgagtgactgcagattaaataaggccacatatacatgttccagccaactgccctggctgaagttccagcagtagccaccaggcatgttagtgaagaagccttcaaaatgacttcagcttcatctactattttattacacctatatgagaagccctgaacccatctgagacccagaatcaaaagagataataagaaaaacgaatgttgtttttataagctcccaagttttgagttgatttgctatatggcaatagttactggtgaacaaggtaagcacacctgtattacacaggtgagctaagcattacacaggtatgccaagagataactgagtcacacaactaaggtcaatcagttgtaacacgaattcttacttccataaagacttgatttgtaaaagaaaaataataaaacataaaaataaaaaagtattaaaataaatgtttgaaaaagatattccttaagaggcccttcctaaagaaggcatactgcatctagcctacatgtggagatccaaacaaactattaatgattacaaataagccgccctgacctgcttaaacaccggaacacagattagctaaattccatccaataattcattcaaattctaggaaccgacaaatcccataaaatgtaataaacatgacttaaatgagagcattcaaatatccttggttcgcaaaaattgactctatttttgtaacatccacagcaatacctctggacctatctctggtatcaagagacaaaaaagtcattttctagaatggttggtaaaattatatatcatctcttccagaaactccaaatatctttaccaaatgtaaaaatggactttcattctacattttttgacttatatttttaagattacattatcatttataaatataatgcaaaatggaagagtgttgatccacgttgttgtaaatatttctttacccttaactacttattgaatgcctgttgtgtaagaaggtgaatggagtctttcccctctaacactctatgtgatagtggaggcttttctcacatacactatgcattaattattttagccaccccatggaaagttgaaagtatctttattttagagatgagaaaactgagtaatagagagaaaatagcatatgcaggtcccacagactagattcctattatactcctgttttcatcttaatatcttagctatggaatattccttaatgttcttcgaaaagtttaacaccattaaaattcttatttacatcaaaataaacatgaatagaataattcagaggacaaaacaggaaatgtatttgggacatggatgacagaaaatttcctattcttatttagaattatcacttatatgtcaagaagaaaaataacattcccacactattcaaagctttttttaagcatcaatttcctaacctattttgataggtaactccatttgtggagttacatctttgtaagatttttttgaagatcagaaataataaatgtaaattacatgctaggcatttaacatatttcctaaatgcagacacacctagtggaataaatgatgtattttggttatactatccttataaaattttcatacttaatgagggctttaccttaaataactttttgtttttaagttacttacactaaatcatttttttaaaaacctctaggtttttggactataacacaataacgctcctttaatcttcataaagagaccactatgaacaattttacaccaagaaactgtaatctaaaaacatggttaaattcctagaaacataaaacctaccaaatctgaactgtgtaaaaatggaaaagtctgaatagatcaatacaagtaagggattgagtaagtaatttttaaactctcaacaaagaaaagcaaaagacgaggtgacttcataagtgatttctatcaaacattttttaaagaaaattaatgccaatgcttcacgaactctttgaaaaaactgaagtggagggagcacttccaaattcactttataaggtcagcattaccaaagccagaaaaagacatcccaagaaaactgcaactcaatatccttgacagatatagaggcaaaattctcaacaaaattctggcaaattttaacaacacattaaaaggatcatataccatgaccaagtgagatttatccttgggatacaaggatggttcaacatgaaaatcaattagtatgatacaccacgttaacagaataaataagaagtcacatgttcatttcattagatgctgaaaacttgtttggcaaaattcaacacaatttcactatttaaaaaaaaccattaaactctcaacaaactaggaatagaaggaaattgcttcaatgtaaaagccatatataaaaagatcgcaggtcatatcacaacaactgcgaactgaaaggattttctatgaaatcaggaacaggaggaacaaggtaagtatgcccattcttgccacttctaccgatggcaatactggaagtccttgctagaataattaggcaaaaaaaaaaaagtaaaggtatataaatcagaaatgaagaatgttattcctatttgcagatgacataatcttatgaatagaaaaccctagaatccattaaaaacactagaaccaatttaaaaatcagtaaagttgtaggatacaaaatcatcatacaaaaattagttgagtttctaggagacaaattccattcacaagagcaccaaaaagaaaacagtaataaactaaagaggtcaaagagtatgtactgaaaactataaaacattgatgaaagaaattaaagatgacaaaatcaaatggaaagacatcctacattcatggatcgaaggacttaaaattgtcattacattcaaagaaatctacagaactaatataatctttatcaaaattccaatggcatttttcacagaaacagagaaaaactctgaaattcatatggaaccacaaagaatcccaaatggctaaatcaaccttgagaaagaagtacaaaattggaggtatcacacttcctgatttcaaaatatattactaaactacagtaattaaaaataaattgtattgtcatgaagacagacatatagaccaatagaacagaatagagcccagatataaatctacacatatagggttaactgatgttccacgatagagccaagcatacacaaggaggaaaggataatctcttcaacaaatggtgttggaaaaactggatatccacgtgcaaaataatgaaattggtgcttatcttatgccatatgcaaatatcaactccaaacggataaaatatgtaaatgtaaaacctcaatccataaaactcctagaagaaaacattggaaaaatcttgtgacattcatcctcgcaattatttccaaaagcacaagcaataaaagcaaaaaaaatagaattaagactacataaaactaaaaatcttctgtttagaaaagggaacaaatcaacactgtgaaaaggcaatctatggaatgggaaaatacaaaccatatatatatattatgagaattatttctaactcagagctattaggagggttaaataaaatgaattatataaagaatacttcatggtatagctacattctaagttatcaaaaagacagcaaccaatatcatgattactattttaaatacatcagggcttaggtaagattttgtgatcagacctgaagaccttatattatattaacaactggttatcttctaaaatatataaagaattcctacaactcattggcaaaaaaaaaaaaactaaaaacgcaattaaaaatgggctaaaggcttgaacagacatttctccaaagacgacacccaaatggtcaacaggtgtatgaaaatatgttcaacattatgaattatcagggaaatgtaaatgaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattcaaaaagaaagagatcctgccacattaacaacatggatgaaccctaaggacattatgggaagtgaaataagacagtcacataaggacaaacactccatgattctacttataagaggtatgtaaaatactcaagctgatcaaatcagagagtgaaatagtagttgctagaggctgtggagaggaggaagtgggaagctgctaattaacgaaggttcagctatgaaagatgagaaaattctcaagatctgttgtacaacttgtacctatactgaacaatgctgtattttacacttaaaaatcagttaagagggtgaatcccatgttaagtgttcttacacacaataaagtaaatttcaaaagaagttaaacgataagagtgtaactgttgaaaataacatcatcacatatattcacttcaaggttccttccagttttaaaattctactcagaagtcttcagtgtaccaatttatagagttgagctaaaacctaacaattctgtttctgggtaatttgttcagtcacatcaggatgtataaaggcttcctcgaagcaaattagtgatacttttaatctaaggagtggtctccctggctggcttcccatcctctgtttgccaattactttctacaatatgtggacagtctgagggacaagttgtgccaggagggggcaaaggcagagatagagtgaaaaatctcctctgcctcatcccctcccaacacaggattgctggatgtaaaatcacccagaagtgctttttctgctttataaaaggcattactatgttctgctctgcatggttccaagattgttcctcagcaacctcagaacaaaaaaggatatccttttccttagaatcttttactcggtatattaacttgccgaactctatacaggttgtgagtttgtttataaatcagaatccaggctatctcttctcataaaagtgctaataaaaacataaaaattttctcagatcagaccacaaaatcttatctaacccctgatgtatctaaagtagtaatcatattggttgccgggttttgagaacttacaatgtgcttataccatgcaatgttctttataaaattaatctcatttaacactcctaataactatatgagttagaaacagtttcaataatacacatgaggaaactgaggcccagagttcaagaaattctctgaaggtcacatagcaagtaagtaataatgaaggctcttaaaagtagatgtaggggggcagaagagtataggtaagagtgatgtcatatgagaaagactcaatttgcccttgttagctttgaagttgaaagggggcaatgagccagtgaatgtggtcagcctctagaagctagaaaaggcatggaaatggattctcctctacagcctccaaaaggaaggcagccctgctgatatgttaatgttagctgaatgagacctgttttaaacatctgaactaaagaactgtaaaataatgaatatgtgttgattaggggcactaggtttgtagttgttgcatcaaaaatcgaactaatacatatagacacatgattagttatcaggatgggttaatttaaaagaagtatgtttttgtccctgtggccatcaactattcagggtagtgttttgagaccgagtcttgccctgtcacccaggctggagtgcagtggccgatctcagctcactgcaacctccacctcctggcttcaagcaatcctcatgcctcagcttcccaagtagctgggattacaggtgtgtgccaccacactcgcttaatttttgtgttttcagtagaaacagcattttgccatgttggccaggctggtctcaaactcctagcctcaagtgatctccccgcgtcatcctccaaaagaggcgggattacaggcatgagccactacacccagctcgcggtgtagtttgtttttttaagtgttacaatgagggtagccttcacttttactgtcgtttgaacctactctaatcagcaacacctccaaatacacacacatgcacacaccactgaaattgttcttattaaaggggatataaactagagagagcatgtaactttatcggtcaaaatgggaaagttttaagagtgaataggagtgttagtaattccactgtagtaactgctatatattaggatttcccagacatcgtaccctactgttttcctaaattcactgaataattttcaatcatcatgttatttgaactcatcagcaatatttaatgtagttaggtatcttcctttctctgaaaacactttcttctggattccagaatgccacatctatcttctcctttttctctcccctttctagccacctttttcagcccctttgctgatgcctcatcatatatacatctagagatctcatctgtctacacatttttccttggcaatcttatcctggccgatggatttaaataacatctatgtgttgacttctaaattattatcctcaactctgatcttagaaccccttctttacatgcattcatagcctcataggcacctcaagattaatatgtttaaaactgaaatcctaacgttcactcccaaacctgttccttctacagtctcacccatcttggtttgtggcaactctatttggccagttgcttaagtaagaaacctcacggtaatccttgatttctctaattatttcataagtcacatctactgcatcaggagggaaatgactttgatgaaatattggcctccaattctgctaccagatatgctatgctagaggatcatgaaacagaaaagctcacagataaaattaaaaggctcatatcataccatttattttttttatttatgtatttttgagacagagtttcactcttgttgcccatgctgtagtgcaatggcatgatttcaactcactgcaacctccacctcccgggttcaagtgattctcctgcctcagcctcccgagtagctgggattacaggtgtgcgccaccacacccagctaattttgtatttttagtagagatggggttttaccatgttggttcggttggtctcgaactctgacctcaggtgatccacccaccttggcctcccaaagtactgggagtacaggcatgagccaccacgcccggccttaccatttattaaatgagttaaaaacgtatggcatgagggaagacagcaggaggataataaaattagaatactttcagacacagattgttttgcatgtttatgtgtcacttgcttcaataacagtacctggcacataataggtgattcaaacacaagcgctaaataatcaaatgtatgaatactgctctatgtgtgcgtaacgcaatatataagaatcaccgtcgagaaagtgcagcgtcaccctactataatgagcatgggcatggagttgaataaatgcaaatttgaattcaggttctgccacttactaattaggcctagaaatacaaattaagttggccaatttaaaacagagacaaaagcactctgagctaagggaagcataaaagctaatatggaaaattttggggcacctgtgtgggagaacgagtgatgtaatttggttgaaggaacatgaaatacgtgtgtaatgagcataaaaatataaaatattaatatatcataaatcttttcgaggcagtttaggagagtagccttgttatatggacaaaattaagcgaaaaaaattgtattattagggctctgaataacattaaaaaatggacaagaaacttcataataaacttcacttggagacatactaggtttgagatattagtggatatcaaggtatagatacatacaaagagttgaaaattaattggaaatgtggctataactcaagtaagattggaagtggtgaagacagagatacaatgatcatttgcatacagattgaatacagattgaagccaggttattaaattattattaaattatgttgataaaagaacaagtacagagataagaatgccaagatatttcccatgagtttcataagctaaagaagttggaagaacagaaagagccaggtaatgaaagacacagaatagtcagagaggaagaacccgctgagtgtagaggctgagaaaaatgtttcatcagtggtagaaagttaggagagctgaataaaagccatttgtctctgtgattaagaatacttatttgttgaataaataaatgaagttaaagcagagtgatgtgtctggggagtgagggcatgcacgtgttttccataggggacagtcacccacatggctctctcctcttatagagaacgttatttttctctgtagaccagcaagtaaacactttaataaagctttctgatggaatcagatccagcctgtcttgagttcctttgaagtagagcaggtacagcctgtaggggcagtgaaagctcagtccttttgacacttttgaaataaatgttcttagtgtgaataattaaggcatacacttatcaaacctaactacatgtaacatcatcttctgatatgcttcctttagtgacagaatatatcattccccatcccccatctcttgtgatttgtgctgtgtcttttttaaatgataaacattacatttatttgaatggcttattttaaataaaacaagtaagtgaatttgttgaattatctgtgatttatgacatattatgtatttggtaatatttacacaaaggtagaatgagcagagcctagcaagatgtaagtccatttgtaattacttcattaaggagtcatacctgagcgatgccttaatgaaggtggtgatgaggtgaaaatgtgctaccagaataggcattggagaaaacctagaaaaggcagctcaataaagtgataatgagagggggaaaaaaacccctatatctttgcttggtgtatgctccttaatcttaggaggtggcacttattccttaagtcttggtgatttcaacggagggaatggtgataaattgagtctagagagtcgatggagagtcaagaggtccagaatgagagagagtgagaagagagctttgcaagtaaactagccaaggatggaggtcataactatttcaaagcttagaattttcagctaatgcatcgattaactgccaaataaattactaattaaatgcacaccactatcttaacaaaaaattgagtctccaaaaatgtacacattttttagccgataggatcaggtctatcatttttaaactcccattcatagtgtagttttgataaaaatcacatcctctagcacgtttcgaattggctccattgagcaaaataaatcatttttgttaaaaagtaattcttgcaaatctagcaatcctagcacatttcattcccacgctgtaacatttataaggctatttcttgtatattgggttccatacaatattgaaagggtggaaaactccactgagtcttcctcatatagaaagtactaaacattgccgagaatatgacctggtttcagtgtgactttttcttataaatactacagagcctgctatacacaagtttaaattagcaaaattaaaggagagcatatgaagaagcttgcagttatatttttcttacatagaatatatattttagaatgaatagataaaataattcacttagaatgtatgtatttcctttacgtagatccagaaaaatctccccaaatagtgtaattagcaattttcacagatgtacctacacttttcgaagttacatatataaaacttttcatgagcctcatgttttttataaccattagcagcctttgtcaaagagaaccttagaggttattacataatgaaagtagaaaccattacgggaattcatatttatgaagaatcaacgtatagtaaacctagagaagactcaataacaaagcagaatcacatgagggaatcaataaaacttggaaaaacaaaccagctcttcacgaggagataaaaggcactgaaaaattcaagcaagtaaaagcagtgttagattatcttggaagcagttctctggtttgtacaacagagagtaaatgttgacagacctgtgaaggaaatgggctccgtgtagggtcagaggtggtgacataagcagcctgtgtgtaggcatagctcttgaatcgaggcttaggggaagaagttctctcatatccctgtgctagactgaccgtgatctgcagagaagggtttgggggagtggatagagaggagggggaaaaaccataagtaacccgaaaggactactttccaacatggtagaaaacagaacattaaatggaaatggtgagattcaatgtttaatactaaacatatataaatgatattcgaaattggtatactcccagaatgaaggcacttaatatcatgttggagagtaaatgatctgggaagatatgagcatgctatttagccatgaggattccaaagtaacacaactccaacatttatatgggatggtactcttcaatccggcaaaaacaggcatccataagcaattttctctaaatccaaagtaaataaaaacagaattcatcaggtccataccctggaaaggactaaaaatttcataagctaatacagagctagctcagcaaagtgagagagtttggcctaagagctctccacacattcagcagaaatgttgctaaaggtttcttcactgttgtttgtgcctgagaaagcataggaaaacatccaaaccacccactgttgagagaaagaacaagccaatgtcatggaagaaccccactaaattctatacaattatgtaacgaagaatttcatcatgtttttctttattgtttatttgaaatagtttaaaacacttttctattttcaaaattgttatcctgaataatcaaaatctgactttgtacatcatattgtcataaagtattttttaatgattaaaaactgtatttgcctttaatctttctctagctctttgttctagttgatgaagattttagagtttaatatgtacgtaagtttgcctttcatttcattgtgtgttacacaatggaaatttaatatattatgttctatattcctatgatatggtacatatgaatagtatttttaaaatatgttttgaaatgaatattgtagtcaatgaagcaaaattgaaaaggtttagtctgtctctttttgtacatatacatacattaggctttgtatatatacacgtgtatatacatataagttatatatatatgtgcacgtaatacctaaaaatgcatataaaacagaaaacatcttgaatagtagctgtcctttacacactttacctgttgagaatagtgcatttgatgatgtaactgaaaatgttcttctttagtcactttaggtggccttggcaacatttccacttcctggatggcttcaatgctcacttgttgaggcaaaacttggaagagtgatgtgatgtacattaagatggacttcttatctggataggtggtatcaacatctgtaagcacattaacactacacatcaatttttggtttctatatttgagactctaaaaggataatgaacaaatcaaagttaaaggaagacgatagattaatgaacagtgaattgtccatgaatgtcctccagagactaattagaacatgagaatgaggcctaaaatgtctttccaatttggcagaccaatgagatgagcagtaaagttaatttattttccttgttcatataaaaacttcattccatattactttttcctaagtcaaattgccaaactagcccatctaacagagtagctttcattagataagaaacaaaaataaaagattacattttccctccaatggaaagttatattaacatgtcaattcaaatggtgcactggtaattaaacaaatacacaaaatggtttaccgctttggttctcagtaaagaaacctgataccttttaactgaatgttgctgatattaaagtatgcagagagctaaataagtctctgctgaaatgagtcatgtatccacaatataaattaaacagaaaaataccatataatgatttttactattccgtgtatgttaaaaatatttgtttacattgtggtgcatgggataaagtagaatatcactttccttctcagacattagagacaaatgtaaaagtcccgcacattaagttgatctgacttcatatcctttgccacatccagaaagtgaatgaaacgcagcatttaaagtcaataatactttgtaataacacatataaagtggcagctccttcaaaagattcatttgctacttggcattaaaatttacttactgcactcattccagtgaaccaagatgtaaagtaatcctttatgtgaagtatgtcattagtactagaaatgttaacacataagttctgactatgaaatgctagcatttcattgtcatcctttttcatcctttaaaaagaaggaaattttgtcattgagacagcatgtgtaaatctggaggatattaagtgaaataagccaggcacagaaagataagtaccacatgatctcactaacacatggaatctaaaaagttgaattcatagaagtagagagtagaatggtgtttaccaggggctgtggggcaggggttgggaagatgttggtcaaaggacacaaaatttcagttagataggaaaaataagttcaggagatctattgtacaacctagtttataacaatgtattgtattcctaaaaattgctgcgagagtagatattaagtatactcaccatgaaacatgctaagcatatgaagtaaaacatgtattaattagttcaatgtagccattccagaacgtatacatatttcaaaacatcgtgttgtacatgataaatgtatgcaattttagttttttaatcattaatgaatataaaaatcaaagataaaagataaacataaatcctggcaggaggtcaaggtaatgtggcaatgtattttccttgccatacaatttatcttagcttaactactattaagatatctgtattcagtatgtatattctgatcaggtgttctgattataagtgaaaaagccaagagtaaagtctcaagtccgttagcacaaaagcaggttgaacaagtgacttcatcaattcttttgcaagtatcagaaccatgattaatcagaacagctatttttaaagtatttttaaaaagagttacaagagacgaaaaaattaatgttccttggtctacttctatccgtagaacaatacagtgcttctcaattcttaatgtacatatgaatcacctggggatcttttaaaactacagaatctgattcaatagatcggggtagagcctggagctctgcatttgcaatagtctcccaagtgatgctgaaactgctagtctgctacattttgaataagggccaaaaacattacttataagcagactgttacatcatctcccgttttattgttttattcatttattcaaatgatattagacatttcaatgcacaaggctgaaaggtacaaagttatacaacacatatggctcaacttattacactttaattattaatcaacagatggtcaaagtaatttttgcaagtactttttaaagaagaactaaataatattttgtgcatgaacactgccttccttaataatcttacaaacttagctttggaattctgaagcctagaaatctccaattcatttgataattgtttttcaaaatatttgaccaattgtttcttatatagtagatactatacttcaccgtatcttgaaattctagaaaatgttcttccttctcactagtaactagtcagctgtacctgtgattagcataacttagagctctttcatttttagtatattaaataaaaccatgatgtgagaaaacaaaaagggttgagcctgtgcctattcactgctgtgttatacatagacacatgcatgtatgtttggtctcaaatatatgccattataaaaagtaaaaaatggtgaaaaattggccaagcattatttttattgccccccaaaaaatttcaaacattgtaataaatttcatttacataaaacatgtggactaaatgcagctgttcataaatatcagtcattacaataaatatgcacttatttaaccaaactattgccattttgccccaaactattactatcccacttctgagattatgtggaattcaaaactgccagtaggtagaaataagtaatttttgaagaaaggaatttaggtcttctaaaatattttgaatttcatcaacatacattttcaagaaatctattatattcaaagtattttaatggattatccaggaaatttgaaagatagaaaattcatgaattctgcttctaatttggaataagaaagtaaataatagaagtacaaagtaattgcattgctgaacagaatttaaaatgtgttcctctaattggcacaaccagttgtttaacatgttcagatttttaaaatcatataatattggaggataaggcaattctctttaaataggaaactgaattaattatgcataggatttcaatagctggaaatgagggaatggggaagagtattcggggcagtgggaatatgtagaataaacatgcagaggtagggacacattagcgatgtcttggcaacagtggctttgtgtgtcttagagagagtagagtagtgaaaactaagatgaaactggtagattgtacatagaaaactgagggatcatcaacagcaaactagaaaacctggccttcattcaatagactagagagtaaatacttttcaatgagagggtgacaccatcaaaattttattaaagtaaattctttaagtacagaatggattgctggaggaaaacttgagagaaataggaggctaggaccataatccagatataaagtgttcaagatctaaggtacaactgtgtacgggggaaatgaaaacaagtcaatgaatgacaaaaattctaagatggatcaaaaatgacttcattcaattttcaaatcatttactccacagtctttggaaatgcctatatacaaagttatgtgctacagccttaggatataaagattaataaactgacaataaaacaaaggaggaagaggacgaaagaggacactgattgttctgcagccatggtaacaagtagacaccaacaaaagtttcaatctaccctatttattcatttaacaattagttcctccatgattcttatcatgcttcccccagccaaccagcagcaaacactcccttctgaaactttgccagagtggattcacttcaatgaagataattctcaaactaattaacaatggtctcacctgagttaccacgcttctaaagctatcatcatcctattcccaatctgaaatgttcttagattgctggacttctgactccccccgcaaaacctaagaatacgctcctttcagagactgtggttgaccaggagcattccctcttatttaagatgttatgaagcccaaatccaatgtttagtaaaactgtaaagtttgttgaaccttaataccattactatgttgcatttttttgtcatttttgtcatatttttgctgtttctatcattaacacaaaaacaaacctagttgtaggagaccatttgtatactattaacaggaagccagaagaatttacttagaaggaaaaagcatttatcacttattccatatgtgctaagtgattgtcatgtgctatagaatatacttagactatgttagattatgagtatatagcagatgagccaccccataattataaacattactttttatgggaaatcaaaataaatgttatggacttcggggtaatcctcatttatgatgactgcactaaggccaattcctggcactctgtgatcacctaagtatttgttaagaaactcaatacagaggacagttaaagtcatagaaattgatgagaattatgtaagacagtgactaaaggcaatggtatgataatgagtactataaagtatttgaggagtatgaaaatgatgggatgtaatttatacttcttattacacgacattaagattttatgaaatgagagcagtggctgaatccccaaagtaagaacttaacaattacatgaacgtaattttacaccaagactctactacataaaatgctcacggacaccagattttaataattgcttatccaatctttgaagccgtctcagaatgaaaatagtgagaactcacaatactgctagagattttactttatgaacaataacaccgtttctgatgagtgtttcatatttgaggatactatggaacaaataaatcatttagcgaaatttgatcatttttcgaataaagaagttgaacctcatggcggtctgaaggcaaattcaaaggctagtcaaaatcagattagaaaccagtcattgcactacactgccatggtaccttaacctcattctctcagatactatctcagtgtatttgaagaccaagtatcgcacaaagtttgctttcaacatgccctcaccccaagaaagtcaatgtgagtaagtaagatgaaagcagtgccttcaacaaaactaatcttgggcagtcaacctcagggaagtccgattagccagtcgctgggtgtaaccttcaaacaccgctgggaaatctaaagaagaggctctactgtctaaatttcaggccaagtttctgccaagggacaggcaggaatggaaatacagaattataatgcatagcatgtgtaattgaaaacaagcaagatttcaaagatagcaggtataaatgtgcactcacaaagctttagttggtcagtcttttaagagttttattaaacaacaaaaactgtgagaggatgtcatttagaaaccatgatgagcatcaacctccccacagggtttgtattaggaaacaaaaataaataaattcactgagaagaaaaggaatagagaaactggaaagaaggcacttctggtcataaactagccatagccagaatgctcaaaatatgaaaacagaaaggcctatatgttggcacaaccaaaacctatggttgtaaacaataacctaattcattgatgtgatattctaaaaggacaaagtgctggaagtaaagtggattattttttgaggcttgcatacgaagagatttatgttataatatcatctgatatctaaatgctggagtttctaagttgtagaccatatcatggcaatggactaattcattaaagcatgatattgttatttttaatattttgtatttggcattcagcactgactgcattgtacatacatgtattctctacttacaagtcactatatacaatagatatacaacattttaattaaaatttgcacaactcctcccatgttaaattttttaacattctgcaagatatgttctgccttagctaaattaagtactccttaattaatccatttttagcacttcattcactgatacaagcagttgcttttaccatttagtaacaatgcttctcattaaaggacggtaaaatgtcataatggaaataatttgcgttgatgaagatgattgaatttcatcataaaattaataacgataaaaagtaatggcctatatttatccaggagaaacacaaaacaattttatcttttgcactttccattacgcttttcaacatgcttatggtgtaactagcagaaaactatcaccatcatcttgttacaagtagaaaacagtggctcaggctgggcgctttagctcatgcctgtaatcccagcacttcgggaggacgaggcaggtgcatcgcctgaggttaggaatttgacaccagcctggccaacacggtgaaaagccgtctcaactaaaaatataaaaatttctccacatcctctccggcacctgttgtttcctgactttttaatgatcgccattctaactggtgtgagatggtatctcattgtggttttgatttgcatttctctgatggccagtgatgatgagcattttttcatgtgttttttggctgaataaatgtctcagggatctagaactagaaataccatttgagccagccatcccattactgggtatatacccaaaggactataaatcatgctgctataaagacacatgcacacgtatgtttactgcagcactattcacaatagcaaagacttggaaccaacccaaatgtccaacaatgatagactggattaagaaaatgtggcatatatgcaccatggaatactatgcagtcataaaaaaggatgagttcatgtcctttgtagggacatggatgaagctggaaaccatcattctcagcaaactatcacaaggacaaaaaaccaaacactgcatgttctcactcagaggtgggaactgaaaaaagagaacacttggacacaggaaggggaacatcacacaccggggcctgttgtggggtggggggagtggggaggggggagggatagcattaggagatatacctaatgcgaaatgacgagttaatgggtgcagcacaccaacatggcacatgtatacatatgtaacaaacctgcacgttgtgcacatgtaccctaaaacttaaagtataataataaaaaaaaaatgtaaaaattagctgggcatggtgatacacgcctctaatcccaggtgatcccagctattcgggaggctgaggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagcactttgggaggctgaggtgggcggatcacctgaggtcaggagttcagagaccagcctggccaagatggtgaaaccccgtctctattaaaaatacaaaaatcagccgggtatggtggtgcatgcctgtaatcccacctactcgggaggctgaggcaggagaattgcttgaacccgggaggcagagatgacggtgagccgagatcacgccactgtactccagcctgggaaacagagcaagactccgtctcggagggggtaaaaaaaaatctatattgaaaatatgagacacagaaaaatatactccacaaacgtttattgagttactttgtgccaggctatattttagactttaataatacaatggtaaataaatgatcccagagatatgttctcatgaaagaatgactgtaatgggaaaggaagttacgaataaataatttcaaaattctcagtttaccacttgccactgtatccctgcttcattgaattgccttccataaaagccctcttcgctgggatagtttttggaaattaaatcagaatggaagctctgcagtgttaataccaaacatcctgagagtgcctcagagcaaatgcacagaagctggtggggaaaagtcagttaaatgaaaattcgcaaccaactgtgactttaggagttttaaataagacgtgtttcagttgaaaagtttttcaaaaatcaaatttctgccgtgtgccctaatcaacaggaaaagttctatctttaaattttcaatttccaaatgcaggaaattttcaaaattgtctcttccgtcacaattgtcctaagtttacatatgttaaatatattttatttgaaaaatacatccttgactatttaaatccttagaacaaatatttggtatgtaacttctaaacccaggagaacagacactaacttgacataacaaatggaagctactcagtcagcatgggagactacagatagaaaaacatctgtactttcttacaattctctcgacatgcctgttgtgggaagaactattagggtttacatttgagatgaaagtattttgactcagtgacatttaactctgcttaagtgattgtcacctgcggttttcgtgctttgcttttgacctaaccaaattgactttttctttcctctgctgctagaaaaagtatagtcagtttcagaagtaactccaccccttatcttcctcgctaacataaaatagtctatttgtgaaccttaattgtttacagtgttagaagttatacttgatacacagtgaggccagaataaagatgtttatttcatgtgacataaatttaattggttattattctttctggtatattttgggatttcaaaatatgcctgatggtataagggcagtcctggggcaaattactcaatgatgactagcttaacgcagatattgtacaaaatgatcaggtttttttttttttgaaaaaaatatggtaaaaatggacccactacatataaaagagcttagcctgttgaggcaaaaataccttgatcaaatcctgaccctatcactaataggtaagggactgtggtaaaattcactaatttccctgtcccagtttttatctataaaatgagtcatattagtatcttgcaaataattagggatgatgttaacagagaaaatgaatgcaaagtaaatgctcaatatatacgatctattatttttcctgatttccttccaattggcacataattgtaattcataggtttgcttgcattcatgccttcattaagtatttgtggaatgcctaccatgtgtcagacatgataccaattcaccaagcaattaatcacgttttataattagaatggctccatttcctaattcctaaggaagaaacgagtggaccattggacaaaccagatggcatacaacactgatgtgactctctcagcacaaaacatttatgtgggatggtgtcatggtggtatcatatgtcatacgcaacatcagaataaggggttcagtgttgagcaaaacaccatcacacacaaacttcaacaactgacaaaataactgatggcgaattaagttttcctgaactaatccaaagttttcagtagtactctaactgaaaactgaaaccagtggacgaacatcacgcatttgtgtattttctaagcactactggaggcatgctgatgaaacacacccaatcaagaagtagcaaactttaacccattttcaaattacaaagatacattttccttttgacagtacttatgaaatttcatttgagtttggagtttctggcttccaccattgtaattaggacctcccaactacaaatacaataatatccatggatgtcaagtaatttccaatgtgaaaaaaatgcaatttagaaatttacagaagtgaagataatcaaatgtgaagcattgatggagaaaggtacaagtgaaaaagagagtaagcatccaaaaccatgtaacacaaatatgatgatgataagggataactttataaaagagaatgtaataaatgatgttaagaatgcgtaaaacatagctgagattgattttcattaaaatgtatatactaaagtatattttttgaatagtgaatagaatttgatgtatgtgttaaaagacactgccttccatgcctgtaaagtacagcatgacccaatccttcacacttagctaaaagcactctaatgtcatccctctttctctttcacacattggtcttgttttgtttttgcatctcaaataccgaaggccattttacacctcttgatcttcatatttggtgctcttttacctaaaataatttctctttttgcatttttgattcattctcacccattaggtcttaactcatatggcacctcttcagagatgcatttcctatcccatttaaagaagcccaacccctttccctttattttacattgatttcctttacattgcttgtcacaaactgtcattattatgtttattttttatataagaatataaaaaccacaaaggcaggaacttcctttagattgttttaccaatgactgagaagtagtaggtactcagtatttgttaaatcagtaaatgaatggagagagaaccttttgggaataaaggttcattttcatggtctacaccccctgaatgtagagtaagacacatgttgaaaattgagcactgcttgaaggggcagaaagcacatagcaaggaacaggagcagcctgtatttttctccctacaaaattctgcaaaagagattcagtttggtatagaattagtttttatcaagtatcaattatatacaagaacttttattatgtttttttttcatttaaattcaccactctcttgtgagttaagaatacagcccaaggtcatacaaccaataagtgacagtctgattaaagtggaaaaaaaaaagtagagtccttggtttggctcccagttctttcattttgtgaccttggataaagttaagcataatgcacctcagcttcctattgtattgcaagaagtttttcttattgatcacatttccaaaaataagacttgatttgaagaacatctcatgctctagaaactgtatcagattatttttaagtgatagggaaagaagcattaatttccaaattagagagcattagcaggttaatcaagaagcctatgagtgatgatgacaaagttagtacattttaaattcagattgaaaatactcaagacacaggaaaactaatgttttattcattgttctaaactttggcatacacactacaaaatagcaccgtgctttacaaaaacgtattttcaaaaataatattgactgatatctacagaaaaaaaaatgtactcaagtgctctcagactgaggataggaaaagcagactccttagaactttggaagcatagcttccaaaaattttgtgctaagcgtctgcatacctgggggtttgaaagattcaagtgtgtgaattccttgtcatctcactaaaactatgagtcagcggtgggtaggattctaccaaataatgataattgtaaaaaatgctttttaagctcagatatatgagaaagggattcaataaagaaacaaaaacctaggatggtatacacacatttataaacaatatgatcactaatatataactataatatgcatgcaaacattacatatttggaaagcaactccctttgactagatattagcaacttcaaagactaaatagagaaaaggaaaggctttgcgtagaatcttactgctattttaattactgaatgttccttttgtccatttgcaattttaaaatttcttctttccttttctcagtggctggatgagggttaaaactgatatgctaaataccacataacccattttcttggtatagcttccagttcttcttgactctgaaatgtcggcctctctcaaatacctctccctcaggtagagctctactagcaggggcctgtctttcctgatgaccagaaacccaggggcttggtataactatctcaattactatatcctatggagcctgactccttatcatagctccagtccccatatgggctctgatcttggattgaccagatgggtcatttccactcttatctcaatgggaacgtgccccttgattaggaaagctttccctcagagaaaacacatcccattgacggttttggccccaagagttcaaccgttagttgtctttgatattttaatttcataagtctggatttaatctctcacttttaaacattttattacaaaagccatacatgcttattgtagtggaaaactaaaacagtacagacgcatttaaagttaatagtgaaagtaccccatatctctacagcaccacagtcccattagctagaagtaatacttgtcaccagatgctatgtcatccatacatccatgcatctatccattcagccattcttttagctatccatttatcatactcatctgcctgtctaatgagattaaacatatacactgtctatgcatgtactttcttaagatgtgctcaattagtaaagattcaaaatttagctttaccactcactggtattatgaatttggataagaaacttaatttcttcatttcttcataccctcattggtaaaatgaggcaaagacttttccaagaaggtaagtgcaagtaaggcatttagagcaatgcctggcataaagtatgttttcagcaaatttcaagtttaaaatgtatatacacatgtatatatacaatgtgaacttcaaaattaatttcagtaatgcatgtattcatttatccatttatttattctgtaactatttattggacacttgccataagtcgaggattatgctggacactgcagctgaaatagtgagcaaaaataaaaacaaacacaaacaaacctagaccctgattttatggtgcctatagtccaatggtagagatatatctgcctaacagtccatagcatgaaaaatactggagctactgtgtacaacgctgcaatgaacatccttacacatttgtcgtagatatgtatgagtattactatatatctaattcttaaatgtgaaacctcaggatcaaatatatgtaaaattacatattttgaaagataatactaaattgtctgattaaaatattacaagttgtgtttcctccaaaagaaacacagggcctatttacatgaaccctcataataagaagatatttgtactatgcatttatttattagttaagcttaattttattttgatgggctatttctaattttcccaagtgaatgtcctgaccataatatgtagccacttttaaaatattatactttgtatattcattgtaggagtgttatcatactgaggttattgattttttattactagtgtcattctgcagtccatcataggttttattactgtttaatggtctttcacaatggaaaatattttaattttgtgttggtaaatttgtcggtattttacagcctctaggttttatatcaccttaatattattgtaatattcttctacattgtaataaagtatttaaatgtttattcacattcaatcattatctgaaagttatcttagtatttgttgtgccttgggtttccacagttgaaggctttattagctaacctattctatctctagagacatgaaatgtcaccctaattgtgtactaaatttacctaaataaaagggaatgttgtcaaaatatctattccacaccattaaattatttctctatcatgtcatactatgttaagtatgttataaaatctactaaagcaaatcacctgtttgaaaataatttcttaactgtactcacgcatttacatttaaacaaattttagaattatctagaaaactgaatccctcttaccattcatgtgatttatgttcagtgtgctcaccctgaacataaacaccctttcttctctgcttattctctaagtggctgaccctttcacactgtatctcctgtgatcattagctggctagattccagttgcattaagctggtgggaagtaccagctggagattgaaagaagagggaaagagaaagctggggaaatttctctattatttccctgctccagagctgcataatgtagtatctgagttctaccaacaactacattccctccattggtgcagctttcactgaactccgttccccctttcctttcagctactatatagtaggaatagtagaaatagtaactacttcctactattgctcctctctagattatttcttgtcacctatttgttaatatatacttctgtaacttttaaaatacaattatcttcattttaccatctgagataaattctatttattgctagggttctgttatatcctctaaaataatacaaatatagatacacagagagtcgcatacatacatgtttgtgggcatgtgagtgtgtaattatacagatgctcctcgacttatgacagggttacattccaataaacccattgtccatagaaaatatagtgagtcaaaattgcatttaatacactgaacctgtcaaatattatagcttagcctagccttccttaaacatgcaagaacacttacattagcctatactttggcaaaaccatctaacacaaagcctgttctataaaaactaaagtactgaatatatcgtgtaatgcattgagcacagtagtgacagtgaaaaatggcatgattaaatgggtactcaaagtacggtttctactgaacgcacactgctttcacaccatcataaagttgaaaaatcattagtcaaaccatcttaagtcagggaccatctagatcttgattgaagtaacttcaggaactttagatttaaggggtacaagtgcaattttgttacatggatatgttgtgtagtgatcaagtctcggcttttagtgtacccatcacacaaatagtctacaatgtacctaataggtaatttttcatctctcacccccttcccactctcccatcttttggagtctccaatgttgagtattcaattctgtatgtccatgtgtacccattgattagttaccacttataggaaaatacagtatttgattttctgtttctgacttatttcacttaggatgatagcctccagtttcatccatgttgctgcaaaagacataattttattcctttgtggctcgttagtattccattatatatacacaccacattatctttatctactcatggacacaacttgattccacgattttgctattacgcatagtgctccagtgaacatgcgagtgtgactgaagttactttcaatgtacaaactaacttagggagaactagcattttcatcatatgtgacttcctttcctcatgtctttatttatgtacttatatacaactttaaacttcctataaaaaaaagcttatactttcttgtgcggtttacttctaagaaaactacatagattttggaacttctcttttttaaaaataattttattgtgtgttttaaggtatacacatgatgctataagatacacatgtaaatggttaccataatgaaaccataatgaaagaaattaacatatccatcatctcacataatcgttcccccaccctctgaccacgagaagctataatctactcatttagtaaaaattctgaatacaacacactattaactataatcctcatgttttatattagatctttcaacttgtttatcccacatatttgctactttatagactttgacctacatctccccatttcctccttccacccccaacctggtaaccactgttttattctctctatatagttatacacaatggaatattacttggcctttaaaaaggagatcttgggccaggcgtggtggctcatgcctgtaatcccagcactttgggaggccaaggcaggaggatcacaaggtcaagagattgagaccatcctggccaacatggtaaaagccaatcactactaaaaattcaaaaattagtttggcttggtggtgtgcgcctgtaatcccagctattcaggaggctgaggcaggagaatctcttaaagccaggaagtggaggttgcagtgagccgagattgtgccactgcacatcagcctggtgacagagattccatcaaaaaaaaaaaaaaaaaaaaaaaaaaggagatcttgaccaggtgtggtggcttatgcctataatcctagcacttagggacttagggaggccatggcaggcagatacgcagatcacctgaggtcaggagtttgagaccctggccaacatggtgaaaccccatctctactaaaaatgcaaaaattagctgggtgtggtggtgggcgcctgtaaatcccagctacttgggaggctgaggtaggataatcacttgaaccggggaggtggaggttgcagtgagccactgcactccagcttgagtggcagagtgagacttcatctcaaaacagaaacacaaaaaaaggagatcttcttatttgccacaggacagatggagccgaagaacattaggctaagtgaaataagcaagacacagaaagaaaaatattgcatgatctcacttgtttgtggaaactgaaaaacaaaaagtaactatgctgagtatcattttattaccactgtacatttcctaattttgagatcattttacataatgagaaaatcatattattttcaaataatttatcttgtgctttccaatatatatttcatgtaactttctctcgtcatataatattggctaggttctccagaaaaatactgaacagcgtcaatacagaggaggaatattcttgtcgtatttattgtttgagtcattctagcatattgatatgatttggatttgtttccttgcccaaatctcatgttgagttgtgttccccagtgttggaggaggggcctggtgggagatgataggatcatgagggtgaatttcccagttgctgttctcatgataatgagttctcatgagatctggttgtttaaaagtgtgtagtactgccccctgctttctcctccttctctggccatgtaaggtataagatgtgcctgcttccccttcgccttccacaagaaggtggaaatttcctgaggtatccccagccatacttcctgtacagcctgaagaactttgagttaagtaaacctcttatctttacaaattactcaatctcaggtagtttatagcaatgcgagaaaggactaatacagaaaattggtaccgagaggtagggcactgctacgaagatacatgagaacgtggaactaactttggaacagagtaagaagcacacgttggaacagtgtggagcgctcagaagacaggaagatgagggaaagtttgtaacttcctagagacttgaactgcttggaccaaaatgctgatattgatatggacaatgagatccaggctgaggtggtctcagatgaagatgaggaacttattgggaactgcaataaaggtcactctcgcaatgctttaacaaaaagagattggcagcattgtgcccctgctctaggtatgtgtggaacttttaacttgagactgatgatttagggtatatggtagaagaaatttctaaccagcaaaacatttaagatgtgacctggcttcttctaacagtatacggtcatatgtatgagcaaagagattatctgaaactggaacttatatttaaaagggaagcagagcataaaagtttagaaaatttgcagcctgaccatgtggtagaaaacaaaagcctattttctcggggtggtgggggaaattcaagctgtctgcggaaatttgcataagtaaaaaggaactgaatgttaataaccaagacaaaggggaaaatgcccaaaggcatttcagaaccctttgcagcagcccctcctatcacaggtctggaggtctaggaaggaaaaatgatttcggaggccaggcctagggcctcactgctctgcacaacctcaagacactgctccctatgtcccagacactccagctccagctgttactaaaaaggccccagatgtgtcttggggtgttgcttcagagggtgcaagccataagcattggtggcttccatgtggtgttaatcctgcaagtgtgcagagtgtgagagttgaggcttgagagcatccacctagatttcagagaatgtgtggaaacacctgcatgtccaggtagaagtctgctgcagcgggggagcctgcatagagaacctctactagggcagtgcagaagggtaatgtggggttagagctctcacacagagtccccactggggcactgcctacttgagctttgagaagagggccactgtcctccagagcctagaatggtctctccagtgacagtttgcaccatacacctggaaaagccccagtcactcaatgccagcccatgaaaacaactaagggtgctgtacaccctgctgagccacagggatggagatgcccaaggccttgggagcctgtcccttgcatcactgtggcttggatgagatgtggagtcaaaggaaattattttggagctttaagatttaatgactaccctgctgggttttggacttgcacagggcctgtaacccctttcttctgatcgatttaactcttttgagctaatgcctgtaccctcattgtatcttggaagtaactcattttgattttacaggatcataggttgaagggacttgccttagtctcagatgagactttggactgtggacttttgaactaatactggaatgagttaagactttggggaactgttgggaaagcatgattgtattttgaaatgtgagaacaatatgagatttgggaggggttggggcagaacgatatagtttggcactgtgtccctgcccaaatctcatgttgtattgtgatccccaatattgaatgaggcgcctggtgggaggtgactgaatcataggggcagatttccctcttactgttccaatgatagtgagttctcatgatatctggttgtgtgaaagcgtgtagcatctctgcctgctctctcttcctccttctctggccatgtaagccgtgcctacttccccttcaccttccacagtgatttcctgagacctccccagccatgcttcccatacagcctgtggaactgcaagtcaattaagcctcttttctttataaattacccagtcacaggtagttgtttatagcaatgtgagaacggactaatacacatatcaagataaggacatttattcccagattagtaagaacctttctcaggacttggtaatgtatttaagcaaatgtcattggatatattacttttgcttttactgataggactgactagttctggcttcctgactttaagaaaaggaagaacaaagattaaatattacctgttcactgttttgcattttattattaatataaatatgtcacataaaaacatcaattaaatgaaagccctgaatttcatcactttaaaagactttccttattgctctttaaaatatatggcaaatgtggatggaagtacacacttagcaaataattttgtcagctaaaactttttattccaatgttgactcaagtgtaaatagttaataaccttccatatttaaaatgctccattaggtaaataatctgtaattggtgcctctttatatcggggaagaggctatattcttggtagcaaaatagtctgattcaattacctacatatatagttactcaactagagaaggtaggcaaataggtgattcacaaacactaaacataactggacatagttggaaatactatgaatcacccatgcatcctctatcatgattatcatagcagtgttcctcaaagtatatctcaacttatcagccattgcatccacataatctgatgaattgaaaataataattaatataagatagactggttggaagcaaatagcttcaaatagaaagtattacaaaggttcagataatcttaatagagctaagcttctagaggtttacatgaaccaaataaaaatcagcactgagctttcatattccttttcaatttctcattatcaatttgtttctctgtgtgagtgtagggtgatgaagaatgaagtagatgaaattttcagtaaagtatacatatgttgccaagaaatcagaggcaaataattctataactttgggtcattgtactaaataaaagagaaaccttagtattgcaaagtttaaactgattatgttaatatgcatttgcctccaaatattatagtaaaataatggaataacaaaatttaattctggtggaaatattttggatattgtacagatgcacatgatgctttgagcatattaaatgtagacttacttttgtgttcttatttaagttattttcactgcttggaatgcctgatactttttttttcatttatttagctgaataaatgtacatttactgttatcagtcagtcaatatccaaatgcttggtgtgcagttatttcccagaatacctcaagagcttggtacacaatgcccttttccaacctctgaacgtttatcaccagatagactctatcatataatacgttgttatcccagcttgcatgtgcacacgtgcacacacatactatatgacctgacccattagaattcattcattcatatatatatatatatatacacacacacacgttttaatattaaagtaaattaaatatattaagtaaataaaatacacaagatacttacaagtaaagcaaacaagacaacattactagcatttctttgactgtttctatctgacagagccactcaacactcgtaacacctattatacgagtcaaatcataccttacaaaagagtttttgtctaccacaattctttattgttgttaccttttctaatttttttcagaatgggaggggaaacaatatgaactcctagaagacaatgcattttaacggtctaataccaagactggctcattttgcacccattaaatgcctgtgaaaaaattgaccaaaattggtcacagatggaacacatctcattgctcttcttagataatttctattacttacattttcttttacaatcgtttttttacttagctcacatccaaatgagcaaattacattcatttggaaatgttattcgattcacattgtttgcccccatggggatttttttaacgcctttttagaaactacttaaataggtcctaaatttattatcttggtccatgggtgttgaataagcaaactgagaaaatcattgttacaactgtcaattctacattaaaaatgatgttaaaatctggtcatacatctctggatctgacatattttagataaatattagaaagggttaagtagctgaggcgatagacattttaactagctagatcaaatctttctcataatgtatgcatagatcaaaacactacattttaccccattattatctgcttttatatttttttaaaaaagggttagctgtatatcgaaactctaaatttatttatcccacataactgcaagtttccatgtacacattgacttatttcctcaccctcactactcctggtaatcaccattctactgtctatgtattcaacttatacattttcttcagatttcagatgttagataacgtagcatatttttttctgtgtcttgcttatttcacttagtgtaatttccttcaggctcacctatgttgttacaaatggcactatcttttgtgaggctgaatatttgtgtgtgtgtgtgtgtgtgtcacaatttctttatctgtcagtggacactcaggttattttcatatcttggctattatgaatcataacgcaatgaacatgagagtaaggctatctccacaaggttctgatttcattttctgtgggtctatacccaggagtgggattgttgggtcatatggtagttctatttttaactttttgaggaaacactcccagacaattttccataatgtctgctctaatttacaccgacaccagcagtatgtcagggttccctttcctccttgcctttactggcacttgttatctcatcttttagataatactcatcctaacaggtatgaagtaataccttattatgattttgatttgcatttccctaatagtgatattgagcacgttttaatttccctgttggccgtttgcacatcttctttgaaaaaaaaaatgttcaagttctttcccaattttttaattgggttatttagtttgtcactatggaattgtgcaagttccttatatattttggatattaaacccttatcagatatatgttttgcaaatatctactcataatctgtaggctgtgtttttcttttgctttccagaagctttttagattaatgtagttccactagtttatttttgttttcttgcctgaaattttgatgtgatattcaaaaaatccttgcaaaggcgactgtcagagagctttttcctctctgttttcttctaggagtcttatgattttaggtcttatatttaagtctttagtccattttcacttaatttttgtgtacagtataagacaagggtacaatttacaacaccatttattgaagagactgtcctttccccacatatcttcttggtggtcctgtccaaaattagttgattatataggcttaggtttatttgtgagatctctattctgttccatcagtttatgtgtctgtttttatggcattacaatactctttttaatactgtagatttatgatataatttcaaatccaaagagcagtatttccaacttttttttcctcaagattgttctggctatttgggatttcatgtaagttttataatgctcttttatttctgtgaaaaaaaatgccatttagattttcacagggattacattaaatttgtacagtcaaccttctatttccacggatgcaactgtagaccagaaataatcaaaaatagaacaaaaaactcaatacaacaacaaaaaatattaatacaagtaaaaataatatatggtaacaactatttctatagcatttacattgtattaggtgtaataacaaataatcgatagatgttttaaagtatataggggggtgtgcataggtatatgcaaatactatgccattttgtataagggatttaagcatctttggattttggtatccactggcatcctggaacccatgtcccgtggataccaagggacagctatatatccatttgggtagtatggaaattttaacaatattacttcttccagtctacaaacatgggatattttcccatatatttaccttttaatttgttcctcaatgttttatagttttggttgtacgtatttttcactttcttctttaaattgggtcttaaatattttattctatgttatcataaatagaattttttaaaattttttggatatcttttgcataaaaatgcaactaattttatgttgattttgtattccactacttactgaactcatttattagttctaacatttttcttgtggagtccttaggggtttctacatatacgatcataccatttgcaaacagaaataatattacttcttcctttcagatgtgaaagccttttattaattttgtctcactgctcctgctagtatttttggtactatgacaaatggaagtggtaagagtgggcatccttgctttttagcaaatcttaaggggaaagctttcagtacaaccaccccacaaccaccgttgatcatattagctataggcttttcataaatagccttgatgttgaggaaatttccttccatacatattttgcgaagagttataataataaaaggatgtttagctttatcaaatgctttttctgcatgtattgagataatcatgtggtttttcatctttctgttaatgtagtatgtcgcattgattgatttgtgtatgttaaaccaaccttgtgtcctagggctaaacccacctggtcacggtttataatccaatgtgttatttgtcttgctaatactttattgaggactttcacatctatattcctcctagatattggcatatatatattttcttctcttgcggtgtctgtttgactttcgtatttagggtgatgctgaagtcataaatggctttggaggtatttcctcttctattatttagaagattttaagaacaaatggtataaattactctttaaatgtttggaagaaatgaggagaagtaggtcaaaggacacaaacttgaagttatattggataaataaatctcgataactgcttagtatgatgactacagttaatggcattgtattgtacactgaacattagctaagaaaagagactttaggtattcttaccataccaaaacagttattatggaagataatggataggataatttggttgaattcagtaatcatttcattatgtctatgtatatcgtaacatcttgtaccccttaaatcaggggtatgtaatcttttggcttccttaggctccatttgaagaataattatcttaggccacacctaaaatacactaacactaacaatagctaatcaactaaaaaaaaaaacctgcaaaaaaatctcataatgttttaagaaagtgggtgaattacagttaggctgcattcaaagctgtcctgggccacatgtagcccatgggctgtgagttggacaaggttgccttaagtacatccagtaaaagaataaaaactaaaactaaaataattagcacatattgttgtatttcaaatgatgacaattagattcgacagttgacaagtcaaatataatacatttaaatggtgcaattctacttcttgaggaaatcctttcaaaaaattggtccaactggaatgtataaatatacaattaagaattgtgcatttaaaatcaaaagtaataataaactctaaattaaatcagacttttttgctgaaactaaacgaggtgaataaaataggtgaagtgaacctaatttataaggctgttatggctcaaattcttcaaataaatttctgttcagttcttatcattttcataaagttgatttatgaggaactatgcaaatctagagtagtctactaaagtctgctttttatatgcttatttcacacaaaatggttattgaccatatgtattttgtctaggcccttaccaagaggagctgttaacataattgatttacaattcagttaggaagaaaacatgttaaagctaattttactctgaaacaataaatcaacccaatgtgaagtatatcacagcccataaaatgaacagtgatccaattgtacagttgaaccatgtagctcacatatcccatggcacttaaaatcttcatccagtcattaaataagtctcaagatccaaaagatttacataagcacaactgaataactttattagctcttctcttctgggtttataatgatgaactaaaaatactaacctgttataaattacatcagtaatctttcagctctttttctcatcatattataaatttacaatgttactgagattaaaaaatgtttatcatatgttaattatttgcatgatctttagcatttttaaacaatggaaaaaagagagctaccaaaaccagagttgtgttcttggcatcagaaagctctagtaaacatcaaataaactttaacagcttagtgcgtaaataacacagcctcaagtacaacaccttagccacagatagtacttaataaatagtcattgtttggttgtatctgtgtaacacaacagaagaaagtatacaatcctaatccttgctttagaatctagacattgttttcttagccatttctgcaataacagttaaaataaacgtaccagcatttctggtaaagactctaatatataagggtgttccagaaatttcaatatactagatttgacagtatggcttgagagagggatcccactgctgagcattctctgcctctcatatcatggatcatagtcacttatgaaattttatctataatattgtagtccataggtatatatatgtatatgcatgcatgtgtttatatacatgctatgattctacaaaatacttgacatctttaatgaccgcctataaagatacacatgggctgaaaatggatgaaaaaagatattccatgccaatggaaaccaaaaaacagcaggagtggctgtacttttttcagacagaacagatttcaagacaaaaacaaagagtcaaaaaaggtcattatataatgagaaaggggtcaattcagcaaaaggatacaacaattgcaaatatttaggcacccaacactggagcacccagataaataaagcaaatattattagagctaaagagagagagagatctcaactcaaaggctgagtagggtactagggggtggaggtaagctggggttggttaatgggtacaaaaattccttagaaagaataaaacatagtatttgcgagcacagcaaggtgactatactcaataatttaactgtacattttataataactcagtatcattggattgtttataacacaaaggataaatgcttgagtggatggataccccattctccatgtgattattatttactgcatgcctttatcaaagtatctcatgtactgtctctctctttctatacatatatacacatacaaactatgtacccacaaaaatttaaaaaattcccctggaatatatgcaatttctaataggtatatctcttaatctaaataatgttttgaacattctcatatacttttatccaatatatatgttacaaatttattacagctgaagaatctacgcaatcttaactttctatggaggcaatgacactactataaactatttatgacactgcggggttagcaaatcaacccatgaacaaatgtcattttctcttttgatcatattattagttcgatagataaggtcatattcacaatgtagcttatcaatgtctcccataataaattcacagacaaaattttgaatctgtactaaaatatagtattttaaaaacacacatgtggcagcacaccctatccaaaaagtgatggcaaatggccttgtgtcagtttaaagttatatctacttgatggtcatgtgactctcatttggactgcttccaccaaatataccttgccaatgatcttggatcttaaggcataaaaatacagctattataataaaatattttactctcctggaaagggtagcttttactctttgtaataaaattcagctatggatgtcttagctataataatatcgaaaccagtaagataaaatttaacagatcacctttaagtctgaaattaatattggaaagagcagttataaggactgcatgggtttataaattatttgtgggaagttttttttattatttatgactgacatgataattatacatatttatggggtccaacacaatgtttctacacacagacattggatgtgctaattaccctgaattaattatcacatattcaaagaaattataaatatataagatgatggattcagatattatttgagaatcaaggcaattcaaattctaggcctaacgtttactagatgtaggagctatgactaccatgacgataaaggacaccaaaagtgagcccaataataaaggctgtgggtattcatcttggagatggtagattcataaagaccttttcaaatggttaaaggcagtcatggttcctctaggttgaagtaaaatcaatgtgtgaatgttacaaagatactgatgcttctttaatgtgacaaattttaggcatgatatcatctttaataattataatagactagcaaaaaaaagatctgcttcagaaacacttccaactggtacaaaaattcagttagtgaatgcatagatatctctaatctgcactagagaaggtaatctgcccagattggcttagattacacattgtgtcttatgttcgcacacattatctcatttgctcctcaaaaaatactaaagtaggtggaacaagaactatatagagatgaattcattgagacttgtataaaaatggtttcacgagaccattgagtttataacagagcagaactctaaattctgattaatgttcaagcaactgactagaccaccttctaaattcatttactagagtcctgcttacacctctataatcaccttaattaatttttctatatcaggcctctgcttgcattgatattattggtcccttcagtgaataataaaatacttgacgttcctatgctgaatttttagaaccaatatttccttaggaaaatatccggaaacatgactttcctaatttaggatacatgttactgcgtcataacaacaaatgtgttaaaagtatttgttgatgattttctcttaaatataaaggtttctatgatgtatatatacacacatatacatgtatatacatacacatacacacatatacatattagcctttaaaatatattccaattcacttttatttaccaaattagactgctgtaaaacatgattactagaaaatgtaccacacaaaactctgatcactctgatcatacttttgtttttaatttaactttttttgtaatttaatctccatagtttataaagggcattactgcttgtcaggaaaaaatgagcttgtatttctcagctgtgtgtaaattacatgcattttatattttttaggcaaggcctctatcaatcaatattttcagaaaatgacactcctcagttaggcagggattgttactgaagctgataaatgtttactcttcattggagactgacaaatagcatatgacatagactactcttatgctcttacactgcttgtactaaaacttgtctagaaatataaaattcaaaaatgtgattttcatgtaaaactgctttcaaatttcttgttaggaagcttgccagacactccagagtaacattttgtgaagcaagtcagtattacacgcataagtaaatgaagtagagatttaaacaaaaatacaacccaatgttgtaatacaggcaaaatataatatttttaaatgatcaccatgtgaggtctatattcaaatgtcttttcataaatggagtccaggcactctttgtagtttatcaagagcaggtttaacagcagtagtttccacaaagcaggctgaagtcatttaatccatggctgctttttatacgcagctgctttatttgagcttagagaggagtagaccacataaatgtcatgttaatattctaaagtgagttaaattgtgttagcaacaaagcttgtcttatcagacatttcaccttggcctatgagaaaatgtgatagttatggtattaattgatattaatcagtaaggcagatatctttgggaatataatgcatagaaaatagtattttcttcctcttcttcttcctgtatttttttgaatctcttggcttcagtgagaacttcctgttggatttattcttatctttccttaattgtttaattttcttctttccacagttcttaaactgaagaaggcctgacgttggccatagccacttaaacactgttagtctttccatcttgccatgccaaactgaaatacttttacctatccactcatttagtaaatatttactcagtgtctaccattttccaactaccacaaaaggtgctagggcgcaattatgaacaaagaagtcagcagatacttttttcacagagcttacagtacagcaaacgggcaacacgtgtaagcaagtaagttcaatacaggttgaacatccctaataggaaaatttgaaatctgaaatgctacaaaatctgtaattttttgagtaactacacgatcatttttaagggaaatccttattgaatcatttcggatttcagattttcagattatggatgctcaactcgtatgtataataaagatattccaaactgaaaatatccaaaatccaaaacacttctggtcccaagcattttggataagggatactcaacatatattttggggcaagttttattatagggaaagctaacattgcccaatatttagtcttgaggcacaaagtcaaccattaatgtagcacttcagctttggaaacatttcatgttaatgaatattttggctgatttttctatgtatgtatcttctgcctcttttcaaacactgattcatggtagcttggcaagctgaatgattctccaagaggagtattatatgcttcaatgtcttatcttaaccacccccccaatctatctttaacatttccacatttcatatatcatctcagcagatttctacccttgtaagtttttgttaaaaagaaatatgccaaatttaatagagtatcatagatgaagaagtgtatatttgtatacttatgtctcttaaggagctttttatactaagaaattcagaaaactacatgttctggttctttaataattaaatatgtgtgttattcttttgactttcctatcaaagtaaaaacgttgtctcagcagggcattcaacatatcttaaccattcaccatagtactgactatgtaataaacaattttctaaatgtactagcaaaactaaagcatatatagtagcacagcctctgctctatatgaccatggtccaggaggtatacttaagagttggttaaatatttatagctgagttagtcatgtttttggctttgggaaactgcagtgttcagatccccactgttaaaatgtaacgtgggccaggcacaatggttcacattcctaatctcagcattttcggaggctgaggcaggaggatcgcttgaggccaggagtttgagaccaaccggggcaatgaagcaagaccctgtctctacaaaataacaataaaaaattgtttaaatgtacctctgcattgtgttgtacacctgcaattctagttactcaggaggctgagctagaaggatcacttgactcaggagttggaggcctgtggtaagctacgactgtgctagtgcactccagcctgggcaaaagagtaatatcttgtctcttaaaataaataaaatgtaatggtgccataagtaaatgcatagatatgtgatccaatccatgagttttaaaatatgtcaggtaacaccaaagtaggacacaaaaacaatttgaatgtttatgaaaaagagtacttcaacaggaagtagacttagagagccataggacagaagagtgtcttcctaggcaataggaatgacgttgaatcacattttggaaatagtaagatgtttgccctaggaataagcttaaagtagtaagagataagactaaaagaaaggacaggactagaaagcctatgaaaaatattagtaactactgagtttggaatctttaatataggtagtgggagccactaaatattttgaataatgaagttacatgatgaaattagtattttattaagagtgtggaggctatgtattcaatagattcaaatatgaaagagatgggagatacagaaaattttcagccatgagcagaaaaagagtaggaatagagcctaccagtgggaaaattaaaacttgaaatattggatcagaaatctgatttgagaggaggagccaagatggccgaataggaacagctccggtctacagctcccagagtgagcgacgcagaagacgggtgatttctgcatttccatctgaggtaccaggttcatctcactagggagtgccagacagtgggcgcagctcagtgggtgcgtgcaccgtgcgcgacccgaagcagggtgaggcattgcctcactcgggaagtgcaaggggtcagggagttccctttcctagtcaaagaaaggggtgacggacagcacctggaaaatcgggtcacacccacccgaatactgcgtgtttccgacgggcttaaaaaacggcacaccaggagattatatcctgcatctggctcggagggtcctaccccaacggaatctcgctgattgctagcacagcagtctgagatcaaactgcaaggtggcagcaaggctgggggaggggcacccgccattgcctaggcttgattaggtaaacaaagcagctgggaagcttgaactgggtggagcccaccacaactcaaggaggcctgcctgcctctgtaggctccacctctgagggcagggcacagacaaacaaaaagacagcagtaacctctgcagatttaaatatccctgtctgacagctttgaagagagcagtggttctcccagtacgcagctggagatctgagaaggggcagactgcctcctcaagtgggtgcctgacccctgacccccgagcaccctaactgggaggcactccccaaaaggggcatactgacacctcacacggcagggtactccaacagacctgcagctgagggtcctgtctgttagaaggaaaactaacaaacagaaaggacatccacacaaaaaacccatctggacgtcaccatcatcaaagtccaaaagtagataaaaccacaaagatggggaagaaacagagcagaaaaactggaaactctaaaaagcagagcacctctcctcctccaaaggaacacagttcctcactagcaacggaacaaagctggagagaggatgactttgacgagctgagagaagaaggcttcagacgatcaaattactctgagctacgggaggacattcaaaccaaaggcaaagaagttgaaaactttgaaaaacatttagaagaatgtataagtagaataaccattacagagaagtgcttaaaggagctgatggagctgaaaaccaaggctagagaagtacgtgaagaatgcagaagcctcaggagccgatgcgatcaactggaagaaagggtatcagtgatggaagatgaaattaatgaaatgaaccgagaagggaagtttagaggaaaaagaataaaaagaaatgagcaaagcctccaagaaatatgggactatgtgaaaagaccaaatctacgtctgattggtgtacctgaaagtgatggggagaatggaaccaatttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaagtgttaagggcagccagagagaaaggtcgggttaccctcaaagggaagcccatcacactaacagcggatctctcggcagacaccctacaagccagaagagagtgggggccaatattcaacattcttaaagaaaagaattttcaacccagaatttcacatccaggcaaactaagcttcataagtaaaggagaaataaaatactctacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatgtaaatgggctaaatgctccaactaaaagacacagactggcaacttggataaagagtcaagacccatcagtgagctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaggaagagctaactatcctaaatatatatgcacccaacaaaggagcacccagattcataaagcaagtcctgagtgacctacaaagagacttagactcccacacattaataatgggagactttaacaccccactgtcaacattagacagatcaacgagacagaaagccaacaaggatacccaggaattgaactcagctctgcaccaagtggacctaatagacatctacagaactctccaccccaaatcaacagaatatacattcttttcagcaccacaccacacctattccacaactgaccacatacttggaagtaaagctctcctcagcaaatgtagaagaacagaaattataacaaactatctctcagaccacagtgcaatcaaactagaactcagaattaagaatctcactcaaaaccgctcaactacatggaaactgaacaacctcctcctgaatgactacggggtgcataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctgcacacatacactctcccaagactaaaccaggaagaagttgaatctctgaatagaccaataacaggatctgaaattgtggcaataatcaatagcttaccaaccaaaaagagtccaggaccagatggattcacagccgaattcgaccagaggtacaaggaggaactggtaccattccttctgaaactattccaatcaatagaaaaagagggaatcctccctaactcattttatgaggccagcatcatcctgatacgaaagcctggcagagacacaaccaaaaaagagaattttagaccaatatccttgatgaacactgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctccatagatgcagaaaaggcctttgacaaaattcaacaacccttcatgctaaaaactctcagtaaattaggtattgacgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaaagtcaaattgaccctgtttgcagatgacatgattgtatatctagaaaaccccactgtctcagcctaaaatctccttaagctgatagggaacttcagcaaagtctcaggatacaaaatcaatgtacaaaaatcacaagcattcttatacaccaacaacagacaagcagagagccaaatcatgagtgaactcccattcacaattgcttcaaagagaataaaatacctaggaatccaacttacaagggatgtgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttacagattcaatgtcatccccatcaagctaccaatgcctttcttcacagaattggaaaaaactactttaaagttgatatggaaccaaaaaagagcccgcatcaccaagtcactcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgccgcatatctaccactatctgatctttgacaaacctgagaaaaacaagcaatggggaaaggattccctatttaataaatggtgctaggaaaactggctagccatatgtagaaagctgaaactggatcccttcctcacaccttatacaaaaatcaattcaacatggattaaaaacttaaacgttagacctaaaaccataaaaaccctggaagaaaacctaggcattaccattcaggacataggcatgggcaaggacttcatgtctaaaacaccaaaagcaatggcaacaaaagccagaactgacaaatgggatctcgttaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaaacaaacaaccccatcaaaaagtgggcgaaggacatgaacagacaattctcaaaagaagacatttatgcagccaaaagacacatgaaaaaatgctcatcatcactgggcatcagagaaatgcaaatcaaaaccacaatgagataccatctcacaccagttagaatggcgatcattaaaaagtcaggaaacaacaggtgctggagaggatgtggagaaataggaacactttttcactgttggtgggactgtaaactagttcaaccattgtggaagtcagtgtggccattcctcagggatctagaactagaaatcgcatttgacccagccatcccgttactgggtatatacccataggactataaatcatgctgctataaagacacatgcacacgtatgtttattgcggcattattcacgatagcaaagacttggaaccaacccaaatgtccaacaatgatagagtggattaagaaaatgtggcacatatacaccatggaatgctatgcggccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacaccacactctggggactgtggtggggtggggggagggggtagggatagcactgggagatttatctaatgctagatgacgagttagtgggtgcagcgcaccagcatggcacatgtatacgtatgtaactaacctgcacaatgtgcacatgtaccctaaagcttaaagtataataataaaagaaaaaaaaacttaaaaatttcagcaaaccaaaatgtttgttaaaataaccattaaccacatatatatccaaatattcattatatataaaaaatttctttaaaatatcatgctcataaatagagtaagttttaattaacaggaaaattgtttcatatgttattatctttaccaaaaaataaaaatcaccaccaccaccaccaacagcaacaacaaaaggggggggacataaaatctatataattttttttttcttgaaaactcagcccaaatggccacctggtgcttcaagacgtgaagtgtgaatacatgtttcacttggaataaaataatatcttttcttatttacatccagatttcaaactccattttaccttgaacacaaagtaatgtgatttagtgtgaggaaagaaaggaaagctttttctatgaaaatgactattttatggtattttctaataattaggtcttataaaacttccccaatgtttttactacaatgctggtagaccacagccagtctgtcttgctccaggatttctgatgatcttattccattaaaaaaaaagactccacaagtcttgaaaactaaactatattagcatgtagttttgggttgatacaaacttctctcagctgcattcccattagataaaactgaatgatgcattggaaacttggaaattaaaaacatgtatctgtggcagaaagataatactgcacacaccatttttctttttgctgcttcactaaatcagttgatgctgaacacgcaataaggtgtataggccaggcccacagctccttttggtcaggtgcaattaggaactaatgttaactgtcttctaatgcgttacatcaatagtacatgaatgagtaataagctctaacttttgcaaaatatgtgaacaaattgatctactactcacaaactcattatccaacaaatttatttttgccctcacaaaaaataaacttataactgacaaaaaaataaaaaagaaatctgatttgatataacaggaattttaggaaaattaaagcattactaggagattcaaaaacggcttcatatagagttgataccatataaattgggtctatagaagcaaaagcctatagacatacaggaagctgtaattaaggtaatgagactagagctcaagtgaaatatgggcaaaactgatgaataaacctgattaagccaaaatcacagagggttaccagtgacttggttagaagtttgaacattttctaggcatccaataatgtggttgcgtaggcacaggaataaaactgagtttggttttggatgatggactttacctaaggtgggtcttgttgcttttaaaatcatcactcccttataaagaaaaaaaaatctatgcagacatcccaaaataacattaagacactgggcttcgacatcagtcctggattcattcaaatccaatctctacttcctattagttatctgtataatatgggtaaattcctttctctcctcaacagtttgcttctacattttaatgtacatgtgaagttcctagcccttaataaagcaattgtaaggcttaaataagaaactccaggtaaagtagctggcacataataagctcatattaaatattagctattttcacaaactgatcaggtttcttttcttggactgccggtgacacagcagaactagtaatgtagattttaaagttaattgaatggaggtaaaactaggagactgaaaacttcttctacatgttcacttgtcacccgtctgcagaacagaattggagaacatccataataacacaaggaaagagttagcagagcagataaggtatacgatatagatgatatggatatacttatagatggaatatcatactaggaagctgtcccaaattcatagaaatgaatctttcaaaaggagaggtgtgaaattcactctgaaattcaattagaatataattagtgactgttgagaatacagttttgatagaataaatgaggcagaagacagcttttaagggattaaggagaaaatggatattaagaaaatgtaacttcaggcatagagaataacttcaggatgttttgcaattataatggttataatggctcaaaacttgccaagtcctgcactaaatgtttcaaatcaactaattcatttaattcttgtaacagtcctatggtatgaatacaattctcactttcattttctagatgaggaaaaggctcagggatcttaagaaatttgcacaagtttacacagctaaaaagtggcaaggttagttttgacccaggcagtccagctccagaacctatgctgtcctccctactgttcacatggcttctgagacaagagtagtgatttaaatttagaacatgtggccaagtcttttaccctaatgtggcaaaatcaggaataaaaaattaagtgttttagtattcattttgggtaaatttctatgagtgcgcttgaaaacagttcatgaaactgagaaaaacacaagtgtaagattaccataatacaaagcatgtgatcactttggaaaggtgtatactactatggaaaaggtataggcaatacttctagttagaatgatttggaaaaggtttgtaggaaagatattttaattaaattccaccagaggaaaagaaataatacagcaattttgggaaattattaacagaccagtggttggagattgagataaatttggaaacttgagaagtatgtggttgaaatgtgaccatggacagtcgaaagtaccactgttgaagtgttttccattgtggaatcttaagagaagagcttttatactttagggcagcagttctcatagtgtggttctcagacatcagaatcaacagcaactgggaatttgtgagaagtgcaaccgctctggctgtactctagacctacaggatgagaaactcagggggtggatcccaacactccctgttttaacaaacctctaggttattctgatgcatgttcaagtttgagaacccttgttttaagggatgtggttgccattaagtctattcaccaaagttccattcttttattccaggctcctgatagtatcttttactctgcctacttgtactttgatatggccatgtgacttacttcatcaaattaaatgtgaacagaagtgatgtgcgccatttccaagcagaagctttacgggttatcgtgtgctttcacatgttctcttgcgttcttaaagtttatattgagatgacccttctctcagcccaggtccttcagctgagtacaatgagttgagacgcctaccaatctatagtgacatgaagtttggcgggaagaaaattctattcttttgagtcgctgagatatcagaattattcttatagatgcataatgtagtgtatcctgatttataggggccatggtacagagaagggatctatttcatggtaaagagaacatgtgtatcaacagatttatggtatctatggaagaggaaaacatgggaatcactattaaacctcagaaaaaaggatcatatattgtcacataaataagagaggagaaagaacagagagaaggagaagttaatgaccaccaacatattaacaatatttatctttcggtgtaagaattttacatgaatatttactatattattatttaagcattatataatcataaaatagaaatgaatattataaaagcataaagtttatgacacaaaattggcctcgaatctcatcttttggagggcataaactcatggaagactttcttaattagaccattttgtgagtgtatttactacctcttgatctgtatccatgtgtaggacactgttttaagtacttcccatgcgttatttctatgatctttctcatagacttgctgggtaaaatttgttatcccaaggttggcattgaattctcaagtgtttacataacatgccctagattatacagtaagtaaatatatactcatggattcaaatcaagttatttatgactctaaaacttaagttcttttcattatagcatgctgttgtatgaagatttatctgagtctgtacctacccagatataggaaggtgtgtgtgtacgtttgtttaaacaagttagtatatttggtaacctttagaaaataagtgactcttgtatgtgccgagaaggaggctggtgatttatgctcaatgtcatagtgtaatagaatctgtaataatcataataacgcaagaaaaatctgatgactggacatagctaatcacacggatattgccactaaatgtacttccattttacaataaagcgatgtgataaagaatcatgactctttgagagggcaacagcgctgacatttctaggtcaaaagttttcatgagattatggagtacctaaacatgtacaattagcctccagatgttcacacatctgcaatatattttttcaaacctttgtcactcactgtcagttaggattcgaaacatactaaagcttttctccccctttttaaacacaaaatcctaaaactttaggagccagacttggcacatatattgttgtcgttaaggtgatatccatgagtccataagacgatcaacaaccttatctgtctgctggattgtacaaacagaattaatagctgccttaagatagagtttggctgaacgagtagtacttctgggcatataaatggacttcagagaagtccatgaattttctggtatcatatgcaaattcttttgtgtttgtacaaatgtgcatgagagggtccaaagcttttgtcatatctctaattggtataataccaacacaatatttggttgcatagtcctgtgaatatactaaaaacattgagttgtatactttaaacagatgattgtatggcatataaattatatctcaataaagctgttccattttaaacatgactagcctagaaccttttaaataaacttgttaggcaaaagttgaagccgcttgatgtttatgttactattagattggtgcaacagtaattgcattttcttgccattgaaagtaatggcaaaaaccgtgattacttttgcaccaacttaatatatttttagaatgtgtgttccatgtcaaatggtccaactcttgactcaatcccaactaatgacctgttcagtgcccttgactatggtgccgtacacttggctatggtcatgccactatgatgacctggttacacagctaccacccattccctttggtaacagataacacaccattctgatattgtcactgcatcttctggcttgtatcactctacagtaatgacacaatccaactaatatgtcttttatttttaggaggaaagaatgatgtgtttattccgttctaaaataaagccaatgtttttattaaatattcttcgtgcccactgggatgtgaatgccaataggataaaatacatcagagaagcctaaggattccatgagaacaaggaatcagacaagtaatcatgtgccacagatagactcagctggtggaagtgaaaatattataggtcaagatgcctcataggtaagaggaaaaatgcgaggtagagaagaccgggagttaatagtgtaagtttaagctgctgggcaaggccgaagcatgaaatattcagaagggatacacagacacccaagctaaagctcatctggacaatcacaagggtttagaggagagtaaatgggacaaaagaatcaggaatgagacctaagcaatgagaaaatgggaagtaaattatgaagatacaaggcaacacagacattgggcagtaggtataaggaaaaaggctggggccaagaatcaaggctttggcctgcttcccatatgtgtgatatttgacaagtaagtaatcttttcgaaattttcatgttctcttctgtaaaattgttacatgaataatttatttaatcctcactgcaatcctacgatgtagatactattatgatccccattttacagatgaagaaacgaaggccaagagaggataagtaagttgccagagatcacactgctagtaaatggcaaaatggagattcaaaccccattaggctggtgctgatgataccctgtctcttcctctgagtccttcgcatttcagtggacattgttccaacttccacctgccagctcctgcatctctttgcctactggagtctgttcttccggagtgcatgcaatagatcaaaaatgctagggagtgaatgcacagcccctcccgggatctgccaacagatgaccagcaggagttggtgtataaataccttagcattctcatctcttcaaaggataagtctgaggtgtgtgttccacataattttcttcaagtccccagtcaaattgagcgccagttgtccaccacagtttaaactcttgaaatgtagtcttcattgactttccttccttctttgtctcactttatcattttcctactcatattccctagcatctcatcccaaataaactagaagggggaagtattctgaaaatcataaagacagggtaaatttaaactattattttattatcattattagtaacatcgatatctgagccaaaatcaaaaaagaaaggacccttatttgtactctttctggttaggattctaaccatgagtgttagaatgttgttggcactgaacccatagttacagtttccaataatttctgaatgccaagaaaagtgaccgtggaaggaaagcagagtttttaactctgtggaatgtgttcagtgggtgaggaatgggaggaagttctattttgctctcagtagaacattaaaaatggcttcctctgtaaagcattctgtggttcccccaagataagggcaggtctgtctgtcataaactgccatagcacccattacttatacaactaaataaaatagtattgagtgatgggtggttagtctctccaatgtagctctttttcaatgaaaatagacattgtgtttcttccagggcctcacacagttccctatatattttacataaaaaaatatatacctaaaatatttggtgcctaataaatatatagaaactatgctaggcacagggcagggtgtggtgatttagctagactatttaccctgtcctcataaacacacaaaatggatttaaggaacacatattcatctttaaaccctctctcaccagctagtaagcacactcagggcttttcagttaccctctacttacaagctatttctgaatcatttctgcaaccatcttctaggaaggataaccattcttacaattttttttttttttgccattcctccaaagttgctcttttgaatattatcaaaacttccaatttgccaaatctaataaactattttaacccacatcttacttaatgttttcagtggaatttagtacttaattattcctctcatgatcaaccctcccacctctctgccacaacctttttggtcttcctagcattgtgtgatcttggtgtcttcttctcataaggcatattctctcatggtttcaactgttaaatatgctaatgattaaaaactgtgcacctatctgctcaaacctcctttttaaggttcagattcatatacatggtggcctagtagacattttaccaaaagcacattaaattagacctaagaaaaatgaaatccatcttctttactccctccctccaaacctcgttatttaaactggacttctgttcacttgtgtaagacattatcatacagatcatcctagcatacttcacctccctatcctgtcatatctagtcattccttaagtcccatcaatgaatcttctccatcccaatcaatcctcttcatctgctttgtcaatactctaggttcaggatataaacacttttcatctggactattaccagtctccgaaaagatacaatttttctcaaatacgtatgattttagaagagattaccatcaggatcattggctcattatcttcagggcagtgatgcggggtgggagagttcttaaaggactgtattctacatgtgattatgagtcaaattttccagaccactgtagacacaatcttacacttcactgtttcacgcagctatgatacctacacaacaactgtaaggatgtgagtttgagatgtagattgttattgcagactaacaaccactccttgctaagtttgtttcaaaatggacttaagggggtgatctcagttgtttttggcaagaaaaaagtaattggcaagaaaaaagtaattggcaagaaagccagagaaagagaaagaggaaatgtttgttcagcccatgaatgagtaacattacaatgctttttataacttcaaacattcacccccatacaaatgctctataaaactattgtcatgatgatcaatcagcattttaagttgaaacatatatatccaagtttctgatcttgttctgtatcaacacagcactcacagaactcaggaaatccctatagcctccttagcttccatctttctcttgtcttttgaaataccttaaagcacaaaagcatattttcaggcaaaggtaaaaataattgtaggaatgatggtttcacagacagggtgtcttcagtgacagttaagttcctatggtgagacactgtaatgagttcaaagtgtttacagcttcaatactgcttgtcaaacactccttcaatgcaatgaattcttggctacaagccacaaatgtgctttgagaaataaaaagcgagtgaatatactggtgtttctattattggtccagctgagatagttgcttttttattcttaataaaagttttctcgaggtagtcataatttcaaaaccctgcttatagtaatgaatcatggttatttacaaagtaattcagtttcactatgatcacgatttgtataagtaatgtagtcatatagtcgaagacttttcagggatgttttctgtttaaactgataagctgcaaaattctgtattttccttaataaaaatgtttcaggaaaaagacagcgaacagctagatttgaagagtaaaaataaagaataaagccagtaggaaacacaaacttctagaacttttaaattgttaaacatctttgtggaagtaactaccattttcaccaaatctgcaaatcatattccaacaagttgtaaaaataagccataattcttagaattgaaagtctcttatcattctacaggtaataacatgacttggtcctgttctctgggtaatggagtaaaatgttactggcatattcccatgtttagacagatttgcaaatagccccagagaattccattcctaacctgggatatgttactcaaagacgttctatctggagtcaagctttcatacaagaatcatagacatacttcaagggatccatgaacactggaaagtatatggaaactatgttcacgttttttatttttcaagaaaatctacaccatccagcagaatctcacacagatccttaattttaaaatgagttaagaagcagtggtctagggcaggctatggttctcaaagtgtggatccagaccagcatcagcgtcacctgggacctttttagaaataccgaatttcaggactctcccagacttacttggttagtatctcagggagtgagacccagaaatctgtgttttctttttaatgtttaatcgacacataattatgcatatttaggaggtacagagtgatattttcctatatgaatataacatgtaataatcaaatcaggctaattatcatatccattacctcaaatatttgtcatttctttgtgttgggaagtttcaaaatcctctcttctagctatttaaacatgcacaataaattactgttaactgaagttaccttacagtgctttagaacactagtacatatccgtcctatttagcttatcattttgtatctgttaactagcttgtccctttcctccctctcctccctcttaccctccccggcttctgctaaccactattctactgcctgcttctatgaaatcaaactttttagctctaacatatgaaaacttgtgatatttatctcttcgtgcccgacttatttcacttaacagtatccaggctcatccatgttaccaccaattacaggatttcattctttttatggctgaataatattccattgtgtttatatgccatatttttaaattcatttatctgttaatggacacttaggttgattccgtatctcaacaatctgttttaacaaggcctccagaaaattctgatgtgcactcaagtttgagaacctctaatttgcgcaacaattttcaaatggattttttacaatgtctcctcaaattttgattcagttatgtttgggaaatatattttaaatcttcccaggcaattctgaggattaacctgtttgggacagctactccagggcaaagctactcaaactttagttggagaacgagtaccatcagcctcacctgggagacagttgtggctgcagaatcttgcccacatccttagacatactcaatcaagcgtgagagtgagacctagggatctgtgttttgctgggtttatttatttacttacttactgtatttgaaacaagatctcactctgttgtccaggctcgagtgcagtggcatgatcatgcactcactgtagcatcaaactcctgtgtttaagcaatcctgatcctcccgcctcagcgtcccgaatagttaggactacaggtttgcactaccacacctcgctaattttttttttaagtattttttgctgtgtttctcagtcttgtctggaactcctgggctgaagggatctgcctgccttggcctcccaaagtgctgggactacaggtgtgagccaacatgccggggaggaatccgttttaaccaccaccttccctgatgactctgatgcaggccacactttgagagcaaagcacagccacagaaaaaattagaaaagttgactattcatgtgacacaaaggcatatagctatgccttctatatgtaggctttgaataacttttaataatagtaaaaaagccaggatagcttttaataatggtagaagctactctttatttggtacttactatatgacaagcacaatggtaatacacgtatttcccttttatccttaaagaaaaagtgtaggccaggtgtggtggcttacacctgtaatcccagcactttgggaggctgaggcaggcagatcacctgaggacagaagtacgagaccagcctggccaacatggcaaaaccccgtttctactaaaaatacacgaattagccaggtgtggttgcggatgcctgtagtcccagctactcggggaggctgaggcaggagaattgcttgaacccgggaggcagcggtagcagtgagccaagatcatgccactgcactctccagactgggtgacagaacaagactccgtctcaaaaaaaaaaaaaagaaaagaaaagaaaagaaaaagaaaaaaggaaaactgcgagggtggggcatttaatcctgttatacagataagaaaactgaggagcaaaaagtttaattttcattaagtaccatagccagctggggtatgagtccagtttgaaagtttgtgattttaataattacatctacagaacttcagaaaatatattttgaaatgagtcttagggctaggtaaacccatgcattacatgtattattaaagggaaattaagaatgatatctcaaaccataaatgatggtattaggtaagtcagtaagtatatcaacatgcaaattaaaacagattatcaatacatagggattgactaagtataatatggcaaccaaattatcccagaattgccctctcaaagtaacaagagcttatacatgtgaacaaattttacacattctgtgatgtaaaaagactgtgtcatcagtcattgcagagaaccaggcagcaagtcacttccttacaattgttcacagctctctgattagctactttgcctgaagcataaaacataagcacattcttcctcacctctatgggtactaactggactgtttaatgtgatggagtaattaacagaaccttttctcccattggggacctacgtggcaagtgccccattaggtcctaggtacatacagaacccaaaaaatagaagccaatgtggggaggaaatggaactcattattttatatgctatggcacgatttcccccctaccaaatttactagactgattagtaaatgtaagccaaaatctaaggtgtgattgaatcactataatatccatcccttgagaactgtgactcagcagataggaaaagagaaaactaatgtccaacatcttgtcactgacacttgtgaaattatcatttgacaaaccatgaaataatttggcaggaatccaatacaacaaatgagtcatttcattaaatacaattctgtctccccagctaaatggtatgcaatgataagatcaccattttaatagttatctagaaatagatgcctaaaattctttcctttatgactttttaacagccaacctgagtacaataatgatattatccagaatttatatggtcaacattcaattgctcacaaggttattaaacagtttataaattatcctgttttcttcccctgctctctgctcctaagaattacatttcttattagaattttcctaaggaaatggaaagaatgaatggaaatgaagtggaaatgttcaatatttcaagttcttaacacgtttggacattatttgaggatcctggctaaagccaagatttgctgaaggcttttagggttcccagttgctataatctctttaagactctgataattgaggtagacaccaaggcagaactacgtaaaattatcatgtctgtaaacaacaaaaaaatgacacacaattaaaagccaaaaaactcattattgaatcaatagtgagaatttatgtggctaacaccacacatagcaaaaaagatttgatgttaggtattaggaattgcagctgttatatgaaccaatgaatcacaatttgttcatattaagacataggtagttatatacagttcactgatcttttttgaaatgtgattgtgagccatttccattggatgaaaaaacagacgccttgccttatttgtcacttttacccatgaaacctagtacatttctacatatatagaagacactcataagtgtttattgacttgtgatttacaacattaagaataaacagagatttttccctaacggaaaatcatgtatattgctacatttatgttaatcataaactctatgaaaactagcatagcattagagttagaaaactgaatcatgtctatcattttcaaactctatccatccttgagaaagctagtttcttcagattaaaatataaatacatttaaaaattctgacaaaagggagaaaaacttcccgtgtttcatatgaagttaggcgaaatttgatttacatttggaaagaagagaaatccacttattttagaagtaaatcaagaaatgtgcaaaatatctatcaggtatgaatttaaaatatgatattcattcaataatttataacagattgctataaatcagatacctgtattgtatttcttccctgtgtcaggttttggaaaccacagagaagtgcatatgacagtgacaggaagcagagccaaactcctaggcagataggggtgggtacccagtgaaaccccacttccaagctgaagacagttaaaggcctgaaagccaaactacaaatcaaatccttgcagtggattgagaacttgtcctcctatttggtgtgctttcctctgattgatctccacccttcacctattttacttatacctactgatatggtttggctgtgccctcacccaaatatcatcatgaattcccacatgttgtaggaaggacccagtgggaggtaactggatcatggggtcaggtatttcccgtgctgttctcatgatagtgaataagtttcacaaaatctgatggctttgtaagggggagtttccccacacaagctctctgtctgctgccatccatgtaagacgtgacttgctcttccttgccttccagcatgattgtgaagcttccctagctacgtggaactctaagtccattaaactctttttcctgtataaattatccattctctggcatgactttatcagcagtataaaaacaaattaatacagtgaattggtaccagtagagtggggtgctgctgaaaagacacgtgaaaatgtggaagcaactttggaactgggtaacaggcagaggttgcaacagtttgagagctcagaagacaggaaaatgtgggaaagtttgggacttcctagagacttgaatagctttgaccaagatgctgataatgatgtagagaatgaaatccaagctgagatggtctcagatagagatgagcaacttgttgggagcccgaacaaaagtgactcattatattttagcaaagagactgggagcattttgctcctgccctagagttatagggaactttgagcttgagaggggtgatttagcgttatctggtgggagaaacttctaagcagcaaagcattcgtgaggtgacttgggtcctgttaaggcattcagttttaaaagggaaacagagcataaaagtttggaaaaattacagcctgacaatgtgataaaaaagaaaatcacactttctgagaagaaattcacgcccactgcagaaatttgtataagtaacaaggaactgaatgttaatcaccaagacaatgagaaaaatgtctccagggcacgtcagagacctttgtggcagcccctcccatcacatgtctggagtttaggaggaaaaaatggttttgtgggctaggcccagggtccctctgtggtgtgcagcctagagacttggtgccctgtgtcccagccactccagctgtgactaaaaggggccgaggtacagcttgggctgttacttcagagggcggaagcccaagccttggcagcttccacgtcgtgttgagcccgcaggtgcacagaagtcaagaactgcggtttgggaacctctgcctagatttcagaggatgtatggaaaaacctggatgcccaggtagaagtttgctgtaggggcagggccctcatggagaacctctgctagggcagtgcaaaagaaaaatgtggggttagagccctcacacagagaccctactagagcactgtctattagagccatgaaaagagggccactgtcctccagaccccagaatggtagatccactggcagcttgcaacacacaccgaggaaagccacaatcaatgccagctcatgaaagcatccaggagggaggctgtaccctgaaaagccgcaggggcagagtggcccaagaccacgtgaacccctctcttgcatcagcatgacctggatgtgagatacgcagtcaaaggagatcattttggagctttaagatttgacagccctgctggatttcagacttgcatgtgccctgaagcccctttgttttggacaatttctcctatttggaagggctatatttacccaatgcctgtaaccccactgtatctaggaagtaactaatctgcttttgattttataggctcacaggcagaaggaaattgccttatctaggatgacactttggactgtggagttttgagttaatgagggaatgagtaaagactttggtgcactgttgggaaggcaagattggttttcaaatgtgaggatatgagatttgggaggggccgggggtggaatgatatggtttggctgagtccccacccaaatctcatcttgaattcccacatgttgtcagaggatccctgtgggaggtaattgaatcatggggacaggtctttcccatgctgttcttgtggtagtgaaagtctcacgagatctgatggctttgtaagtggagtttccctgcacaagctttctttgccctctgtcattcctgtaaaatgtgacttactcctccttgccttccaccatgattgtgaggcttccccatccacatagaattgcaagtctattaaaccctttttgctgtataaattacccaatctcaggtatctctttatcagcagcatgaaaacggactaatacacaagcactgacttctccctgcttagaacacctttccatccccacctgtattttcctccctcatgcctttaccctcttccttctccacaacaagctagtacccagacttccatctaaatatcacttccttcaaaaagacttcatttcttattcctccagatacagattccctgatttactatttttatagcactctgaattttaaatagtacacatcaaaaataaaattaaactattatacaatcataattatgctggtattcctcaaaagacaatatattccaagacatgagccttttcttatgtcttcaataaattcattcaggcctaacagaacactttgcccataggaggtgcttaatgaacatttatggaatttatagttcttccagatgtggttcgactttgcattgagtctaccttagaaatttgtttttcatactcataaagatttcctatttgaccaccacaaaccctctgcactgccactcatagtaagccacacagggagtatactccaaccaagcttcagtacaaattcttccctcagctgtgggtgttctataacatttaattggctttcttaaaatctgacacaaataactaaagactcttgatgctttgtcagagcaaaggagtgtgaaaccattatctcctctaaatactacattatactatactttgtatcatatttctgttaatttagcatttttagaatatttataatacaatgttagttctccctttctgtacttgcgtctacatgttaatatgttcttgagggaaggaaccgagccttattcacctttatataacctagcaagttgaccacatggttggtgttacataacaagccattgaaaataaagcaagcaagcaattaagaaggtaccaaaccctgctcaattctattttgtgggttttgaccccgtgatttagcctatcatgaaaaattctcatcttcattttgaccccccacccagatttgtgccatctgcaaaattgaaaattacccctttgctgatgttatgtaaggtattgatcaattattcagcagcacagaacctgtggtagcttactaattataataaaacaatatttagagttgctggtcacttaatatctaccaagcacctttttaaatacttttacatgtatgtaactacatacatacatgttaaacttaaatattttcaaaacaatcttatcagatggatacaattatcgccattttacagatgaggaaactgaaacacagtatgactaactttctgagggccacacagcttttaagtaatacagctaggattcaaacccaagcagtgcatctcaagatctcagacttttaccactctgccctcctgactaaaatgtgtattctatatacagagctcactctcccaagtcaatatggttattaattcctctgccaactctgtcatatagatcacttatcaccatcttatcccgataccatagaaccttagccactgttttactcaaatagaaataaaccattaaaaaaaaaaaataggtgccacagtaaaagtatgatctcttcaacctgatgagaccatcacaaccagtctcaaaacttcttttctgaagaacaagctattaatttagatgaatgagtcaataacaaacttatcgcagatttaaacatacagaaattttcacggcaaatctgtaaaatatgaggtcaataaatatctaatttatactcaatagcatttatactgttatagaaatgatgcaatatacaagacacataactgtacataacaccctagccattaaatcattgtgcagatggctcccactatcattgtgacttctgtgcctctttccccatagtgtttgccaagccataagctgatattttattttaccttcagttctctgtacattacagcttctctgcctgcaacatccttttcatctggctcctttacatgtcaggtaagttaccactgccccttcaaagcctttccttacggcctgagttttggttcaatgcatgacctgactgtaaaacactatttcccacatcatgtatgtctttccctactcatcacattgctgaagaattgcccatgtatctgcttgtctcccatgataaggacaatgtctttttcctttataacataatgaggagagctcaataatgaaagctcaactttttttttgtatgggtgaatgagtagttctaagtaaatacagtaaatttacttacagtatcaatttcaaagaaattctctcctctaaaaatattgtcttcagacaaggaaaaaaaacacaaaaaacggaacatgactaaaatcttaaaggaagatacggaagtgagcacacaatccttctgaagttaaaatatttctataaattcatatagctgtattctaaatctttttggtaagaatccctgaaatgtattctgaattctaatagatgaaaagttccctgtgggcaggtaatgtgtttactccaactaagagcagcccaacacaggaatatttgctctttgaggagtaatacatgttttataactcaatgatgttttcatattcttgagttcttaattacaaatattttcaaacaatattcaattatttgcttgccaggtataaaatataagttaaatagcaataaaaatatcaatggtttgaatttaataacatgttttttccttagcactatattttctaaatagtattagctacttaattaaacttttcctcaattgggaagtgatcaagaaaatggttgtgtatcaaaaggcagagtaagtgaaaacaagttggttacaggaggaagcagggtatgggtttcgcttgtgctatattaactgctccactggagcaaactaattaatttttcttcattgcactgtaatcagcaagcttaatctagggcaaagaagaatacaattgtgattgcaaatattaaggtcttactacctgtcattcagttgcagtaactacagaaagtctattcaataattaatgtgctatggctattggctttgttttgttattgaatacatttattttaagcagcattaagcgcataaattaaatcttagtaacattttcatataagtaactatcattaaaatgcatttgttccacagaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaaaatgtgtagtcgaatatggtttttgatgacaataaaatcgctaaaaaccaaaagcattcagagagtgtaagagaacaaacacatctcttcaaatatttaaataaccctatgggcaacttgatatgatgtcaatattatatgtcttacgcatctagtttataaaagtcatcaggaaaaaaatacaagattaatctccttgtggatcaatttgggaaacaaatgaataaaaccacagatctacacatagatagagggacattccaaggacaatcactacttcagcctttaatcttctggataactggtgaaagccttggcaggaagcactccaagctacttattaaaaaggtaagaggatgttcttatggatacaatcaagtatatatcaaaccatatgctgtcacttgccccatctacattttcccaactttacagttagaattaagtgatgcaaaacagcttaagagaggatctgatggaaagcaaagtgccctatatccctccacagctcatcactggtttgaagtcaggccataagttcatggtgacatgaaattctcttcaagaccaaattagtcttcgtcagcaagaaattccctacaattcagggtttaactcttaaagagattagctccattttttttctaatttcgaatttacttaacatgacaaattttatatatttatagtatacaatatatcttgataggcatatacatttaaaaatggctcaatcaagccaattgatatatccattacctcacatgcttgtgagaacatttaaagtctattctttttgaaattttcaagcatacaatacattgctattaactatagtcttgttatatacacccaacagttctcttgaatttccctctccaacctaactgaaattttgtgtaaccccattcttaacaagttatatgattcagggatataatagaaaatgttgagacatacacattctatctagttttagcccaactttcaaggctctccagaatttcctctactttgactttataatttttctttcgattctgatatggtttggttgtttcttcccccaaatcttgaattgtagctcccgtaattcccaccatgtcatgggagggacctggtaggaggtaactgaatcatggcggcaggtctttcccatgctgttctcgtgatagtgaatacgtctcacgagatctgatggttttatacaagaaagtttcccggaacatgctttctcttcttgcctgtctccatggaagatgtgactttgctgctcatttgccctccaccatgattgtgaggcctccccagccatgtagaactatgagtcaattaaacctttcctttataaattacctagtctttggtacgcctttattagcagcatgagaacagactaatacagattcctttataggtttattttgaacagtagatgcctctttgtattttgcactgtatcccatcaacccatctctcatttttgctgcagttcctgtttctgctgttagagggttaacaccctttcacttcctagctctagcaacaggaggaggaggaggaagaggagggaggaaaataaattgtccttcaaagggacatttctgaggacagttctataaggttctataatgtcccaggcaaggttgaggtacagttacctattatggtcatcagttcaacaatgttatctttattagcttttccttcttccttgtctcacttttccaggtcccacatgttcctgagttttcttactagtttctttgataatcagccaatcatggctttctgtcaggctttgctttgggggaaaactcaaactgacactcttgactattgctgtcacttaaactgaactcttagagagcagtggtgatacattttaattctttagctttaggggccagagagggaagatgatgcagacttctcaagctcacgcagctctagatggcagagactgcatttaaatccaggtctttctcctccctgcgtgttgctacatgccattttggtacctctctacaggcttgccttccataacctttcaaagttcagcattctcctactcatccaaatgaacacagtagtcatgttttattccatccacttgataaaataatgggtcacagcacagcacttgatccattgttattcaacgaccaagactcttgagttcctgtaattatgtaacaagccccttaactgtcagtggtcataaaggcaagaatctcagacttcggaatcaaaccccccatttactcttactgcaatttgccctcacacaggtattctcaagattacgagataacaaagtgtaagagcttagcacagtgcctgaaacacaggatgtgttcaataaagggtggctattattttcacctggagcaaaacgaccacaaataggggccatgtgctccgcagcatcccctgcctgtctcccaaagccagaacaatgagaccaaataggcgtccacaaacaaaacagacatgtaaaatgaaaaaaataaaaaagataaaatgccctcttttacttcatctgtatgtttttcctatgcccatccctcttctctatttcgaaacatgctctcacattgttttgcaactgggaatactcattttatcttatccaattctaactatctttaagtttcagctcaacttctacttctggatgtttcctattttccatcacagcccttgttgatttctctcatatatttctacagcattcatacactataaagtgaaatttactacttcacaaataattttacttcagacctattgaactattttggtcagtcctgactctcaagttacactgaaagttgctagaaggaaaggatcatttctaatttttctctggggtcctctggcacaatactaaacttatcaggcactgaatgcttaatcctgtagacaaaatgtggaagtaacaaagacaggactcaagaaaaacctaatttactcttctctttctcattcccccttagatgcatttctatattcaatgttcattctgatttccaggtagcactttccccactttctttcctagcttaatcctttcactgctcagcaatatgcggcacacctggcaacatgggagagatgagttagttactgcaaaattgtttgcttgttctcttaatgccttacctcaatttctctatggcaataaggctatcatatccaaacagaagaactaagctaaatggattcatcatttcacaaagtgattctttagcaattttcttattattttatatatttttggtttcatatataatgctacctcagaaattcagatatgcaaagtttaaaactccttttttaaagtttcagagagctacaactacagacgagataagctttagcttgatgaatttcatactgactactggatcttatgtttaaggcagatgcaggtttttcttggggggggggggggggcgggggaagacccaggcaggcccatgtgatacatttcttcaggattctaacaattttccactcagaaagtagtccctcaggaaattattaactgtaaaataagatagaggataaaaaaagaattctgaagcagaaaaatacatggaatcagaagcaaagatgctgaataaatctgcattgaaaaatggaaagttcctattttgtgtttatattatacttttgactcttgtaattattcttcttaaatgtcacaaaaatccccccaactattactattccactgctatgtatgtggagatgtacatacccaattattaggtaacgtacccaaggatcaattagataataaaagaaacattactgtaacacaggacttctttttacactaccttctattaaaaagaggagacataagtatgtgaaatggaatcagtatgccacatagtatttaacagcattattcaattgtcatatttgttagtacctcatgataaatgttaggcagaaagccttctctatctctcttcaccttccagggcaaatatctgccctactttgttgccacagagaataaattttccatgactgcaagctctattgaaaatagaagagaaatggaaaggtccagaatttaaaggaactgtatctctctcccattctactgtatgtcccttgagattagagacatttgtttccccagtgccaatcagagacatgatacatagtgttcaataaatgcttggtgaatgaattggtgaaaataacttatgaattatggttgcaggagggaagaacagagtgatataatgttaaacatattcaggtttacttgcaaggaatgggaaactgaatacttcatatattgatgttgcatataggcatcattatgatcatttggaaattagtcaaaatgtctttaatgcataccttttgatctagctatcctgggttcctagcatgatacctcatatataaatgcacactcgatagctttttgtacctcacataatgacatgattttctataccttgaatatgccttcctcttatttcttcttcattggtgcttttgccttgctatttcacctggaatgctattcttccctatttctacctatcaaggcctttctctaaaatatagcccaaatgtactctccgggcattatttctctctctctctcaagtgattgcaatgcctttttatttgaactctttggactacacttaaatgttatcaactcatgtccaagatgtttacaagtgtcatttgttcctgtgactttaataatgttgtctcctttttttgcagcgtctatttaattttatctcttaccataaacccacctggcctatccagggatttcttcaagaagcacagctactgtatggcacattctacactaaatccccagtatataatctgctcatttagtgataaatcggtgatgctcttcacaggagactgaagagagacactcagaagtcttagaattgtgtgcttctagaatacaaagaatttccacaatcatagagtctgaggacttttaatcattactattttcacagcttttggagtagacagactcagtccccagaaaaatggccaatgtaacttatacacacacatacacaatgatgatgatgattatctttaaatgtgacaggtccacccagtagatttccatgtggaatcaaagtcagatgccataaatgactggagtggcagagtctgtcagtggagttacataaactgtgtgtatggcgagtgcagctccagactgaacagtaatgtgcccgctttgagggaggagagtagcactcctcagtactaccaggatggtgccattgcagaatgttgccccagagctgctagatctgctaacagaaacccaaatctgtagtaaggtgtagatcaaacaaaacatatctctgggttccttccagactttccattaacagtttataacgtcttctgaactatctgttcacatacttaaacctgagtcctcgggctgggcatggtggctcatgcttgttatcccagcactttgggaggccgagatgggcagatcacaaggtaaggagatcgagaccattctggctaacacagtgaaacccagtctctactaaaaacacaaaaaattagccaggcatagttgcacgcgcctgtaatcccagctactcgggaggctgagacaggaggaatcatttgaacctaggaggcagaggttgcagtgaggccagatcgtaccactgcactccagtctaggtgacagagcaagactctgtctcaaaaaaagaaaaaaaaagaaaaaaaaaatcaaaaaaaacaaaaaaaccctgagtcctgactagctctcctgcaggagagtgttactgagttaagcaatcaggagaaatgaaactctatcaaccgatggtcacctattaacaaataagatggcatacttctgtactattgctattcatttatttatccattccacaaacatttttcacctaccatctcttcggcattctcctagctactggctatacagtactgaagccaacggacaaagtccttgacaccaaacattctagtaggggaagcagagaagaaataagctagataatcaaacaaggtaatttcagataatgatgatgattttaaagcaagaagtgtgaataggatacaggaatggctgggagggctcatcaggagagctcttttacatatggtagactgcaaaggattcttctgaagatgagacctttcggctcagactgaatggcaggaagttgtcagctatataaagagggagaagaagtatgttcttgcttgaccggagcctggtgaagtaagggaaccagtgtgaagtgagatcaagaagcaagcaggggacagatcacacagggtcttgctggctgctttcagactccagacatttttctaagtacaatgtagagtcttcagaaggtgttaaatagggaacacatgacctaattaatgtagtaaaaagataactttgtataatgcgaagaactgagagactgcttaggaagttactgcaatattaggaggctatggaatatgatggagtgtcagtggtgcttcctttgaataaaagcagcttttatttttcaattaaaatgtaacataattggtttcagtaaaaatgtctcagttgaccttatttctcctgcattaatggggtcatttatatgatatgtcaggagtgctaccgctgtacacaatgaacagcttttttcaattaaaacgtagcttaattgacttgaaccagaaatgactcttgacatctttgtattaataggaccatttctataatgatcatgctaattaatcttcttcattcaaaagtattgtttattcagaattatttaatacaatcgttatacttttaaatcattttaatgttattaaatattatctcaggatcttgaagtctattggattgttatgctgatttaaagagtgcaaaaatatttatagttatgttttagtttaaagcagtgattaaatataatttgcctgtgaccctgtaggccaaaataatgtatcacgataaactgtagatagtgtcagagatgaaaacagtgtttgtctgctttagtgtattcatatgtgaggatgaattttggcacttgtcagcctatgagaaattactactagactaatacttgtcagtacagtaacaactcatcatgctctaaacaccactaagggagaaaagtgatgaataacatacaaagtaaaaattttcacaatcacattaatgactctagttcaaagcacagtaatggtctaccaaccttattgtccaatctatatttcaagtgtctaccttgatatctttcagaatcaattttacgtcaaattccaattaacatagaaaaaaagcagtagcgataaaaacatgtctctattgacttttccaaaagcaatcgtgctctccaaaccccagcctcatttactattactgaagcaaaacgaaatactaagagtactgtgtgcaaataaaaaacgtttgttgattatctgttaaaaaagaccccaaattaaaaacagcctaaataatgagtattacccgcacacaacaacagtatgctatggatttataaaattatcattcttcctaaactgataacgaaaatctttaaaatgaataaaatgttactaatatatttcacagtatgcactgaatggactacataattccatttgggtttaagttgaggttttttttttttccaactaaatggttaaaaattatgtttagagaacaatctggaaaatatatactcacagacaataggcatacaattgacaattgagcacaactacattaaatttacactataaaactcaatcatccaacacttatgaatccaaacattttctaaaactttacaagaaagcttataggtttttatcatggtaaaatatatataacataaaacatataattctaatcatttataagcatacaatttatcagcattaagtatatttaccttgttgtgtcaccatccccaccatccacctccaaaaattatcttcccccaaaaaacttcatatccattaaataactccccataccttctctcccccagcttctagaggccaccattctactttatctatgcattttactgctctagatagctcatacaaatagaatcatatgttatccttttgtatctggctttttccccttagcatatcatcatcaagattcatccatgctataatgtgtgtcagaactttcttaaggctgaataatattctactgtatacatttaccacattttgtttatccattcatcttcagatggacatttgagttgctccatcttttgctactatgaataatgctgctataaacatgggtgtacaaatatattttgaaggtccttttttcaattcttttgagtatattcccagaagtggaattgctggatcacatggtaattctacgttctatattttgagaaaccaacatatttgtttccacagtgactgcaaggttttacattccctccagcagttcacaagtgttcaaatttttccacatcctcaaccatatttattttctgggtttttttttttttttttggtgttttaaaataatcatcatcctaatgggtgtgaagtgctatctcatttgggatttatctgcatttccctaatgatcagcgatatcgattatctactcatggtcttactggccaaactttagagaaatttctgatcaactcatttattcatttttttaattgctgtttttctgttgttgaattctacgatgatataatttaactgtgtccccactcaaatctcatgttgaattgtaatccccaatgttggagttggtgtctggtgggaggtgattggatcactggggcaaatttctgatgaatggtttagtactgtccgcttggtactattctcgtgatagagagttcttatgaaatctggtcgtttaaaagtgtatgacatctccctccacccctcttgctcctgttctgaccatatgacctgccaggtcacccttccctttctgctttatgtttcctgaggcctccccagaagccgagcagatgccagcatcatgcttcctgtacagcctacagaaatgtgagccaattaaacctcttttctttataatttacccagtttcagatatttctttagagcaatgcaagaatggactaacatataggagttcttggcacagtctggatattaattccctattgaatatatgattcgcaaacatcttctcccattccgtaagttgccttttcactctgatggtgttcattcatgcacagaagtttttaatgttgatgcatttcaatttacctaatttttctgttgtagcctgagcttttagtgtcatatccaagatatttaattgcccaatctaatgtttatgttttcttccaaatgtctacgctttcttctaaaagttctgtacttttggccacgtttacttcctgatccattttgacttaatttttgtgtattttataagagtccaacttcatttattttaaatgtatatattcagtttcttagcaacatttgtggcttcattaaaaaatcattaaaaaaccttggcaaccttatggaaaattgtttgacaatatatagtagagtttacttcagggctattatattctattgttctacattccctttttttaagccaataccacagtgttttgattatggtagctttgtagtaagttttgaaatcaggacgtatgacccttcaacttcattcttttttcaagatcgtttcaactattcctggatccatgagattacatgggaatttttgatagagttgtctatttctgcagaaaaactaattgggattttcttagagatggcactgaatgtgtagtttgttttgagtaactcggatacctcaacaacaatattgagtgttccatttcataaacctggggttccttttcatttatttataaaaataaatgtttaatttctttcaggattgttttgtagttgtcagtgtataagtcttccaccttcttggttaattcctaagtattttactctttttgttactattttaaataaaattgtttccttaatctcctttttggactgcatcactgttagtgcataaaatataacttatttctgtatattgattttatttactgcaattgtgcttaatttattagttctagcaggttttttgtgtggaaatctctagaattttctacatataagatcatatcatctgagaagcttataaaatttttgcatacactctttcaaagctgatttttctgatgaaaatttgaaatgcattgcacagcatgaatatagttaatagagtattgctcatttcgaagctgctaagagagtacacttcaaatgttctctccacaaaagtctttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttcttttccaaaaaagtagccatttaaagggaaccctggtgtaaaatttagaaaacagatgtagaaaaatcataaaatatccaaataagtttttacaaaattttcctatgctatttcctttatattttctttagtccatctccatttatgaattattcaggaaaaaaaaccccaaaatgattttccgtgttatagaagatcatactccaaaattgaccaaaaagcttcatttgttaagactgtaagttctatatgtgccattaaacatacttactttttctagacttatagtcccaattctgacgtttatatccaatttagagtgtcagactatttcttctctcctctattttagaggcagtctgaagtctttcaacaagaaaattttgtaatgaggtgggtttttttccacttagtgtttgatcaggaacaaagcatctaattacttggagcccattttctcatctggaatattaagctaatgctattttgtcaataggatttttgtaaggattataactagtctataaaacattatgcaagtatttgattctactgtcacaagaaccgatgctttcaaaaatacattaattcagacctcaacaccaattagatatataagcatttatgtgttatacctgatgctcatctatatatatacacaccctactatgtgtctgtaaatctctgtttgggagaaaggtgcaatacaccatgctaaagaatcaattattttcataaaggcttaactattgataagagatatagatataacattgagtgtttcacaggagttacacacacacataactttattcaatttccagcaatgtttcaactaaaaatattctgtcaaagtcaatttacataatggtgagattaaagtaaaactaagaaacgtcagtggataccagtagaatatgacagtttattaattttatttataacacacaaaagaaaaatatgttaaaaaatgaatatgctatcttgcaaacactgtctactatggcagacactaagaaaacttatttaataacaagactgaaattagatttccgtcagatgctgtctttagaatttggggaatagagctattcatccctggatgtgtttcttggagatgtgtcaatatcgtaacaatgaaaaacaaaattgctttataccgttagatatttctgatacaatctttgcccactcgtgggtttcataaagctttgtgccaattttgtcaccaagacaagtgtatctgatctaacacaaattgaacacttttcagcaaagcattgtgtatattatttaattccccattcatatgtcatgaagggaaccagcatggttaccacaataaatttatttaaatcaacaaaattcaatgtcagaatgtatcatttttttctatggtatacttaaggttccattaaatttactgacattccttcattttagaaattataatcccactgggaccacgattttcttaacatagaattgaatctaatggatattttcctcttattgacttgaggtaattaagctccccattgagaagaccaccagatagttttatttatgaagctgatagttcctaactatggcagagacaggctgtcaaacaaccatgtcctttctccagcttttaaagtatagatttttcacttagaagcagccactcagccagccactgcattatccttgtagacaggcatggctatatacatgtttcatgagcacacatccccttcatgtggaaagtgaagggagcacatatgcatcacctctaccacaaggcttctaagaagtcactgtggcttttctgtatttgcttccccctcttcaatggctatatgaaaaaacaaaaaaacaaaaaacatcatcatctgtgaagaaggtagagccacaacaaaggcagaaaaatatagaaaaatattagtcactgtaattagtccattttcacactgctgataaatacctgccgagactggacgatttacaaaagaaagacgtttaattcatttacggttccacgtggctggggtggcctcacaatcatggcagaatgcgaaaggcatgtctcacatggtggcagacgagaaggtaacttgtgcaaggagtctcccccttatgaagccatcagatctcacgagacttaccactatcaagaaaacagcacgggaaagacctgcccccatgattcaattacctcccactgggccactcccagaacacgtgggaattcaagatgcaatttgggtggggacacagccaaaccatatcagtcaccaataaggaacacctacattggacttatacctgggctacatataaactattgttttaagctcctttctattttggcacttatgtgttaaagcagcaaggttgtttagctaattcagtgacacgagatcacactttgtttctgatgatttaaataagaattaatagaattcagttgcaccaggccatcaagactaatcatgcccttggaaagatataagagcagatgaataatttttctgtgtcacctcaaattctgtggtactacagcttatagccaagtgatatattctagttttattagtaaattgagtaaacattactatccaggaaaaaccagaaaaaaaaaaaaacaggaggcttataataaatatgacattttatctttgaaatataaaccagcttcatggaatagtcatctttaagttctaggacagtggcaaagtttttaaaagattgaacacatagtcatcaccaataaacccttacttagtacagactatgcatgaagtactaaggtaagtgacttctgtaagataaaaacatggaggaaacccttttgtggttcaggaacatgtattcccaaggttggtgtaactgaaggttagtttaagaatgggtacagaacacatggtgggaagcaataaaaggcaggcatagaaagccggattttgtttagaaagaacatggggttgtattaacaagagaatgacatgcttagacctgtcatcttcaaacactaattgtggtggcatgtgaacaatgatttaaagtaggaggaaattagagactggaagacaagctaagagagggaactgtaattatctgggcagcagttttgggggatcatccagcagagaatgtagaatttaaagtaaattcctctagtattgctattcggaatagaaaactacatttacaatgatttaatacaatatacattaataccaaaagtatagtaagaccttagatgtaaaatgtttacgtgttcttggagttccttttctatgcttgatgatcaattgatgtattaattttagtttttctaacctaaatgtatttgagggcgctaattttgaaagcaatataaatatgtcgattactttatgagttgcataaaattatatacattagtacaataccaaatgtacatttggagagggaatacagattctattagtaatttaatcattcatttatgtttttcattaaacatttaagttcctactgttttaggaccaggagatatagcagtgaataaaatgtacaaagtccttaacttatgaagcttaaattctaggactagaaataaaaataaggacaaataaatatgctacacaaaatcaggtcatggcaagtcctataaagaaaaatagagcaaggtaaagagagggaacaaaaggcatggagaggttggctctacttaagagaggatttagagagggaaagcctttcaactacaggaacatttaaaaatagagttgaatgaaataagcagttgaatcctgtgatgactctctggagaaaacacatttccatattaaaggatcagcaagtacaaaggtcctgaggcaggacctctctggcacttgactcccaatgagcctggatctgactagaagtgaaggcatggagagcctatgattagcgcatgcaatattaattttgattacaaagttactttaaactggattagctttatctccagtgaaacacttttcagagaccacagacaaatcttttggactacatctaaacattttttggaaggattaatatttctataattttgaagccatgtgaaaattaagatgagtctattctcatttagtgatcatgccagccttagaaagactgaaactgattaagtaaatgaaagtttgtcacacttaaggtgtaactactacagatgaaaacagaagccactacaaacctagcaaactaagtagatttctaaagttttcagcaagtgaaaacataaatgtcatctcatcattgacaaattccctaatcccattttgttaatacacacacacacacacacacactctgccactactccttctgtgccccaatacggcttttttcaaactactattatatcaagggctgtgattatgtctttgcaatattttcagtgtctcacccctgaaagatgcataacaacaattggttaaatataactaaatagtattccctgtgatgactctccaaaatatacgagtttctgtaccacttttgctatttcagaggttgactattttaatgctagagccagagacacagtaatccaagtgacatgctcaaactaaaagcactgatcaagaatgagaggattttgttttatctttgaggtttatacattattcttctcaaggatgggctcaacatctaagtatcttacatgttaaatgaaaccattccaagtcaaaaagataaaaataccaatatatttatatagagcactaggaggtcctaactaagccagtgattttgatactctgactatgccatagccaattcaaggagtaatagaaggaaacacctgaaaccggtacagaagaagatagaactagaagaatgggctgtcaatgcctaactgatgagggcattggttggccattcataatttgaaatggtaaatcactagctatttcctaaagcagatactgctgtaaaagtttctgatttctccctgaggtcatttaaacaggtctttgcttcatttttgaatgccgttattaattcatgacatattctactatatgcacttacatcccacaagatgaatctcctttggagggcctattggcccaactactaatataagtcattgttagtagaattctacatctccctttcctaaccttttctttctacgtttacaagggggaacagcaattgaattaaaataaacatcatttaaaaatcagcaatagcatgagttacaataactagtctttactctgtactatatgaagtatttaacatacattaacccatttattattaaccacattgcacaaatgaggaaactgacgaactaattgcttgtgtaaagtttttaaggtcacacatctggtaggtagcagagctaggattcaaagacagtgcagctcaagagcctatgctctttactcttacatagaggtagacgttttaaagggacaaaaatattctgagttgatcatttctccctatgtaagtgaactaatatatcactccctaatcaatccctgtatcctaaagagttaatataggatgtaatataggatgatctaagaactcggatacaacagactcccccctatatcaagcaagagtcccttatgccaagcataattacccgtgatggctaacataaaatcgtttggggaaaataaacatatcaaattgtttaagctcaagtagatttacagaaactcgggcaaactcatgtgttccaagataacaccacagactgtcacagcaactcatctggtaagctaattctgaccaatctgtcgagagcatacttagaaccatccagctcagcgtgtaaaactcttaagtatccttccgtcatgctcctcttctgagaggctatgactattccctgaaggtggtgcttaccctttccctgtaaatttaacaagctcagctttgggtgatcaacacctttgactggaggacattacaggtgtttctatggtattcattcataaactaaaagtagagctgactgaaagcctggtatttatagctagcgagagaaatgtccaattattagatgaggttcattttcgttaattattttagttattatgactacataatagttgtacatttggggtgcatgggatattttgatacatgaatacaacatgtaatgataaatcagggaaattagggcatccatcacctcaagcatttatcatttatgttagctaaattccaatttaactattattttgaaatataaattattggtaactataatcactctagggtgctaccaaacactagatctgattccttctatctaactatatactttttatttttttttttttttttacctatttaccactccctccttatcctgtcctccccacttacccttctcagcatctggtaaccatcatcccactctctatctccatgagttcaatttactttagctcccacatatgagtgagaacttgcaatatttgtgtctctgtgcctggttgatttcacttaacaatgtcctccagttttattttctattatttttctttctctcgctctccttttttaaagctcctctggagtgctctttcttagttttcaatactatattttctgaacatgttttttaaaatctacatctggcatctgatctattcctacaacctatccatattctgtctgacctatatttttatttatactttaattccatttgaatttctgctctgggctttagtttacacttgcaatgtgtgatatctgatatctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatcttaaggatggcaacagttactgtgtaaaaattttagaaatccttttaagtatcaagtatacattcttatgccctgtgcacatcgctgctcaattttggatgtccagcagtgtgcgcacgtccatgtgtgcatgcacataattatatacccatgcacatgagcacattcatttaaccatacaagaagcaatcccagcaagaattctaaaaaactgatatatgtctgaatattactggaaaagagactgtaggtgagacctgggcttcatatggttcaacatagatttgtcagttgatgctgttaattaaaaataatacagaatatataggacaaagtattgtgtgttgatgtaattgtcccatgactgtgccaggtaagaagcgtagaggataatattccctgaaaacagtagggatttctactgctaaacatcttttaaaatgtcagatcctcgcaaaaaaaaaaaaaaaaaatatggactttcgtctagggtgagggaaaaagtttttcccttcgtgccttttgtgattcaagtcccgaaccctatagaaatgagcactgctggacttctaccattgagggcagtttgtcaggccccaaagctgaacagccaagtacaacagaccagagctaagaaactgaacagaaaaaaaactacagagagtgcagtagtattcaattactgttgtaacatattcccaaaatcttaatggcttaaaacaagacaaatgttttatcttacagctgagtaggttagacatctgacatgagtcttattagactaaactcaagcaacagcagggctttgttcctttctggaaattctagaagagatcatgtttctttcccttttctagcttttatagacctccaatattccttaacccctggtcttcctccattcttcaaagcgaacaacagtaggtatagtctttctcaaattatatcactcaggcctactcttgtgcctctttcatttttaagcattccggtgactacatagtgtgcactcaggtaatccaggttaatctccctccctattttaagatcagctaattaacaaccttaattcccctgtgtcatgtatcatgtactatactcacaggttctagggatttcgacatgagtatccttggggagccagcatccaactaccaaaggagagtttaaatatgcaggtttaaacaaaaaagtcgtatcatattgagtatccagatttcactttgtctccgatatactctaattctggtattcccaagtattaaatatcttgggcaccaattatttttgtaaactggtgcctgtaataaatttgactaaattaagctgattatttaagctaattgttcatgtatgaattatttcatcattccactgataggtggcacagtagctcacacaattccaagagatttagtttcaaatgaaagtcgtcctattcatcccctttattattgattttactgcacacacacagagagtcattactagatgggaactgataacaatgttgctcggacacacaatgacacctaatatttatattaatatgctagcacattttttctgttcctattttttgatagctgcaaattagtcttttgtcgcacattccctttttcatgaggtttttaaaatgtttaataaatcatctacatatttaatttttaccactagcatttagacatttttaaagttatcttttgaaactaaattatttttagattttacagatgttcccccttcctgtgtccatgtgttctcattgttcaattcccacctatgagtgagaacatgcggtgtttggttttttatccttgcgatagtttgctgagaatgatggtttccagcttcatccatgtccctacaaaggacatgaactcatccttttttatggctgcatacggcctgtggtggggtggggtggggtggggtgggggtatgggggagggatagcattaggagatatacctaatgttaaatgacgagctaatgggtgcagcacaccaacatggcacatgtatacatatgtaacaaacctgcacgttatgcacatgtaccctaaaagtataataaaaaaatcaaaaaaagaaaaattttaaagattactattcaagatattcttgggaaaatatttaaattataataatcccaatttaaattatactttaattatgtggtcattttatattttaacttgtcatgtatcttctcccatacaagcctgatataaattttacatagaaatcatgatctgtgtatccatatacttctcccctcatagtacacacacttacccgatatgtagtgtgtattgctttagcatactcaataaaatccattgagacaaaatatgccttatgtttctaattgtaacagtcaatttttaccatataaattaccaagaggatttttctaaaattatacgatgaatgtagcaattacacaatctctctacaacttttgtaccatacatggaattctatactagaagccgacattcttatgcccgacagaactatttagttcattttatgagacgtgctattgagttttagataaagtttgaaattttataacagcttattctgtaagaatgcatacaattatcaattaccttgggaataaattgttttacatatttctgagaaccttctgcagcttcttgtatatcaaaccacaggtatatgttttagcatagttaatattttttgaaattaccttcaccactgttattttatttaaataaaggtaatcaggaaggcctttcttcagcttagacaacaaagtagccagtaagatcaaggaaaatattaggtaaaacccaaatacaacttcaatacttggatactgaccatttcattgcttgttaatgttaattccttggattaatcagttaatttaatctatcagcttgataacgtatctgatcagaactttaaaatcctaactggtcttcacacatattaatgaccctcacactttcatgtaatatgctaatgtaaaagccgtgtcttcaagaaacatttgttgtacattaaaaaacaggcactcgcactttcagaggccgaggcgggcagatcacgaggtcaggagatcgagaccatcctggctaacacagtgaaaccccgtctctactaaaaataaaaaaaaaataaaaaaaaataaaaaataaaaaaattagccgggcatggtggcaggcgcctgtagtcccagctactcgggaggctgaggcaggagaatagcgtgaacccgggaggcggagcttgcagtgagccgagatcgcgccactgcactccagcctgggcgacggagcgagcctctgtctcaaaaaaagaaaaaaaaaaaaaaaaaaggcactcttatgctctgggaattcagctgtgaataataaaggtcccagcacatgaggaagtcaccaccaataacaggactgaacaagtctacaactacctacagcattgtgataggccagcagtactatggtgggaacaaactccactggaacattaagtgagaattattttttgaaggttaggaattttacgttggattaaatatcaatgatacaatcaaagtgaaacatgagaaggactcatactgttgtttactctgttaatattgtactaaacagtattgaataaaacaaaatcaacgaaacatttgaaaaacagaagacattgtatctttaaactagtgatgtcattttcttgcattctcatatataactcaatataccgggaacactgtagattctaaataagtattatgtaattaagtaaataaattctcccttgcctctactccagtaatccctcttcccttgctgctgcttgtgaatgtgtcagcctctctcctgcaaccaaatttctaccccagacatactacattcgtcttattccatctctccatgtattgacaagatgggcacatgagtacgtgcacacacatacatccgcatactaaggcaaagtagcttactttacctatctcagagagaaaactagcctaaacataaggaagaatgctcactaaagattttaagatacagataaagaacatttgagtcacctttaagagacataaattacatgttcactccactttctctctatttccccaaatatatggtattctcctcaaactaagatagcaagatatctcagttgatatcttaatacactcagtattcatgtaggctcccaggtaagaaaaaaattattattgttgcttgtctaatcctagttgcatttaaatatgaaatagtaacatggtaattttttagaataaaaaccaattttgaatacaatctaatgaaaactttgaaaaatgttcatttccaaagataaattaaagacagataatttcacagatcatgctctcccttaacattaaaaaggttcttttctcatatatgtattaaatattatcattaaaaatcactagaatatcaaaaaaacagcctacagacttggtgtgtatagtatgtgataacataagcacaaaacaaaacaaaaaactaagaatagtttcaatatgtatgcagtaacagagacacatgctattctgagaagggttaaatcaacaaaggacataatctttctggggttcagctgtgaaatgcagagtggaagaacaacatcccagggagttggaacagcaagtgctaaggccttaaactatgtaaatatcatgctagatgattgtgtgtaaaagagaattaagttaaatccagaaagaaaatagggccagtcattgtcaagttcttcctgcagtcacagaaaaagatgagaataacttgaactatggtggtggttgtacaggtggagaggtatgaatgatttagtgatatacagtgggccctccgtatctgcgggttctgtatctgcaaattcaaataacctctgatttgatacaatagggtgaatatagtcaataattgtgcatttgaaaataacttcaagagtgtaattagtttataactcaaaggataaatgcttgaggtgacatgctattctcatgacgtgcttattccatattgtatgcctctatcaaaacatctcacgtaccatatatatatacacacacacgtatatatatacatatacacatatatatcatatatacacaaacaccccatgtacccacaaaaattatatacacacacacatacacacacacatatatatacctatatggtgtgtgtatatatacacacacacgtatatatacatatatggtgtgtttatatatatacacacacatatacatatatggtgtatatatacacacacatatacatatatggtgtatatatacacacacaccatatgtatatacatatatgtatatatatataccatatatatagatatatggcatatacacacatatataccatatatgtatacatatacacatatgtgtatatacgtgtatacgtatatacacatatgtgtatatacgtatatacacatatatggtatatatacaccatatatacacacatatatgtacacatatatggtatatatatacacacatatatatacacatatatggtatatatatacacacatatatatacacatatataccatatatatacacacacacccctagtatgtacccacaaaaatttccaaaaaaaataaattgtttcccaaataaaaaaatattcaggaaatacaataaaaattaacaggatagaaatctccctgttgggtactatgcttattacctgggtgacaaagtaatctgtactcagagcccctgtaacacataatttatctatataacaaaaatgcatgtgtaaccctgaacctagaaattaaacacaaagaataaaatgtaacaactatttacgtactatttatattgtattaggtattataagtaatctagagataatttaatgtaaacaggaggatgtgcataggttatatgcaaatatgacatcatttatataaggaacttaagcatccacagattttagtatctggagttcctagaaccagttctcagatagtgaggcacagtcgtattcttaaagtataatctataaggcatcatggattgaaatagttctaatacttcacttttttcatacttaaagctgcttaaatgaccaacttaaaagatagatttattattacagagatttcccgatccaagctattaatgtcagtgcagacatggttgattcatggagcgggggtgggggggggaaatacacacctggaactcatctgtgtgtttagaggacaaattaaatcatttttaaatagccccaggatgatctcagccattaaagagcagaaggctaataaaacaactgttcctattaaatcgttttctgagttttataagtagatgtcctcccttatgtattttattggcaatatatgttacctttatagagaagcagcgtttctatagctctcaaaaaggttaagaacccgaggtgtattataggccaatttctcttgtaaatgttgacttaaaatagtttaaagagcattttctcatgttggaggtgattaattgcactgagtttcacttgtaaaaatccattgctcaaacctaaggatggtggggggacacccatctgtgcaaacgtgtggacttacaatgacttttgcttatgttagctcaggtgtcagttctaatgaacaactttcaacaagagaaaataaatccagaactttttattagaaatcacacatgttaaacagaaatcattaactaaaccttactcaaaatagtggtggactttatcacttaagaaatcaattaacttccaaggaactatagaaaaagttaggttcccgctccaaaatcatcttatcgatttatgcatttatgtccaactaataaaattagggaagcagagtaagaactactgtatggatccgtggattttggtatatttaaaatcccatataagaattatgatgcagccacattttcatttgacataaatatttgtacatttattagaatgaaaaacatgctctgtactttaaaaaatattctctgaattagttcacattctgtcttatataacagttacctatatattgtttgttggcctatatgcaattttcaataccttggcagactgtatatcttttacttcctgacacacttggagtatatagcactattccttatgtaaagttatcaatagacatttgatgaattaacatgcatttctactgaacaaagtaagcctggggcacataactttaaaatgcttatgtagcatctgaaagaatttacaatgtcagactaagaataaaaagtaggggctccagaatttctactttattaatgatgtggtcaaatcaacccattggaaaaaatcttagtctactcagccacctgcacaaatgctcgtgctctataaaagcattaaaaaaaaaaaaccttttagactagtctatatgtactctgcagagtaaaagacacattagctaaaacaatagtgctcataatattaatgtatttggcttgtgtaagtaacaatatttaagctctgacaataattctaattttaaacattttcattccatctgcaagattaaagtttgaattattatgattattcaatgcctcttgatcaatctgaggaaagatttctttcaataagaacattccttcaagcactacctttgctatgttcttcactagtctatgttaagattaacgtgaagaaggctaggtaaggagtattatcatttctattataatgattttgcttaaaatgtacatttctgtttatgatgaatgcaaagatattatcatttaatggaaaatttatgtaagacagatctcgctacaactagctttagcagttttacttaggttataacaatttaaaaatttctcatcttatagtcccttaatattccatattttttaacttttttcgtatttcacatgcagtttgttggtgaaagcaaaattcgagatataatagagagaaaaaaatacattatttatttttatccaggagcttatgtctcatttttatatcgttgttatattttgcaatgggtgaaatttgtctttctcttcagtcttttaaaacctagttacttcaccaggttttttccaaatactcaaatgcccaatcgttatttttctatactagttttttccccacttctggctgtctcttttcagagtccctttgattaacaactacaacaatatcatagtctgctgtttaactacagtgaggtgaatttattaagggcttcaccatgtactcttgcctcttgaggaggaataagagtgtgtgtgtgtgtgtgtgtgtgtgtgtgtgtgtgtattccaattattaataaaaacagttttcaaatcacttttccaagagactcacttgcccaactgattctatacagaaaaacttagatattaaagcctaggtaaaatgtatctttttatttagactttctcagataatagcttttttttttaatccacatatgactcaaggtgggatttcaatctagataagagatgttcacatcacgacctcactgaggaaatatttgagatagtgagatgttttgatgcctttgccatctaattttagagttaactgagaaagagtagaggggaatattttcataactggtgagtgtctccctttgataactttagtgtggcttggatagaatgtcatacttgcaagatttgtaaacatccttctactttaattatttaatgattctctcaaggaaacatcatagtaaaaagaattcagtatccctcttattctggctctagtttataaaacttttccatttattttcaaaacatttggaatcaactgatggatgtgcatccaattaaaaacaaacccaattagccctgtaataaaatgagtaaccttttagttaatgcaaagaaaatattcatggaagaagagaggaatattctgccataagattatattctgtagtagttacaagtagggaatcttaactccaactcactagctgagtgatgtgggcaatttacataaactcttcagttgcaaatgaccaaaataatagtctctacctcctagagtttttgcagaaataaaacgaaattatacaatatcaagcaatgtgcccagcacttaatgtttaataaatatcacaccagattacatcaatattactatgtatgtattactcccagcttcagaagttgagtttttctgagagtctgggaaccaattcaaccacttttacgatgtcatatgacgtaatgactacaagagaaaacctagttatacttttgcaagtgtgctaactaatgtcttacaaatactatgacaattataaggtactatcatgaaccagccttcaggagacttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctcaaggatatcaaagattaccacccagtacaccagctgtgagccagcagtattcctcagaccagaaaaccagaatgagtgggaaggtcacaggaagaccagcaagatttcaaatgggaaatgacagtagatcccccttttccacgggggatatgttccaagacctacagcagatgtctgaaaccacaaataggccctatatatactgtttttcccatacatatacatacctatgataaaatttaacttataaattaggcacagaaaaagattaataactaatagaacaattatagcaatatgcagtaataaaagttacgtgaatgtggactctcacctctccctgcccaccctccccaccatcatctaattgtactgtactcatcaatttaaggaccacggttgaccatgggtagcagaaactgtaatgaataagggaggactcctgtatttaatttggggagagtcagcatttattctagaggcaggcaaaataactggaaagatcagttttccctacaggagtataaagggaccatttaatttttacaacattccagttatttgacataactttagctactgtttctgggctcatattacgggccaaatacatacaggttttacttactccttgaagtagcagtgggaggtaaatatttttactttacacgtgagcaatactgagcctcaataattttccagtggcctaaaactaataaaggcaaaaatcagattttaacccaaaactagttggctctgtgtagaaaaagttaaatcaaccctaggttaatctgatgctgcctaggaaaatgaacatagaaacttattttcttaggattaagagttaagataatagtagaatttcttgtcactcttgtttgctaggtaggactactattaaattaactggggagtggggcagagaggcaatatatagtcttttgtcctatgtgacaacaatggtattaaatattggtgggaaattaatgctgcaatttcttcatgtcaagtaaaccacactgattttggccgttgtcctagcagctatatggagcacatttgggtgagaggcatgtggaaatctgtatgttggttgcttctgggccatccaatgatacaaagattctatgacagtgtatctcctgccttgtatccttctgtacagctaagtaaatgtcatagattaaattctattccatctgtgagtataattgccaattttatctccttacaactacactaacagtgcaggctccaaagttcattatgtcctgtcagtaaaagttgcatatctggctaaaatacaaactgtttagcaaaactaaccctggataaatggtaaataaattcaacctatttatggcattaatatcagagatcataaaattaagccatttgcttatttcaagtggatttatgggatcagacttctaatttgaaaactattattttaccatcattttaattgttttcccttattagcccttagttattattaaaaattcttctagttctttatcagctctgccaatgaaagacatttttattggctgcaaaaggcatcaacaaacctcagatagcagaacacagtgatgtcaattagtaacaagatgagagaggcaggcaaaagaagaaataaattaaagaacaaagagtcagggatcacctctgcaaacagctcctctcacctgggcaacccttgctggaaactgtttgagtcagagtaccattctatcacaaacatgtccgtgaagcaataaatagaagaaggaatgaagagagacaactgtgcagacaggagataaggcaagtttcttaatcctaaagagaatgttttgatggccagtcttatgtgacagctagtctatttttactttgtctgtggatgaacaatttctcattaacagaactgttagcaataagcagtactccagtaattgaagatgtgaacagcaggcttagtcattttttaaggaagaaaatgctagaagtctaaacaaatgctgggacaacagattctggatcttatcctataaaagggcatatctcacagaaacaattgttccattgtagttgtttctatcttagctgcaggatactctcacttactgagcttctaaaaattgctgatgtcacagcccgtcctcagtgaaataaaatactagtttcaatcccagtgttgccataaagcttccccaaccgattttattggacagtcttgtgagaaataacacggactttaagaagagataaaccctggatttgattatagctcagttatctattggctgtgtgatcttgattttaataaagctctctaagcctcagtttttccatttataaaagaaggataaacttacctggaattgttgtgtacaagacataagataaagtatggaaattatctagaacatgactgccctacttaaacatttgcactcttctaccaaaaggaacttgcaaatttgagtttatatcactgatgataaattagaaaaatctttgcaggggaaaaatgtgctttgatttgaagcaaaagtttattcagcaatattaacatctcacaagaatgatattacaggatatttcctaaaagtaaaaacactggtttcaaccaccttattaaattgtaataatatataaaattcctaataatttaatagttgtaacagttttctcacttttcaactggatatcatatgatccactaactccacacgattgccataagacaaaaaatctggggcttcaaaatggctgaattgatggatctgttactcacctcttccatggagaggaaccaaagtaccaagtagataatcatactttgaatacattaactaagagaaaacactgaaattcaacagagaagcaatgaaaaccactaaaaggaaaaagaaggaaatgaggcactctatccagctgagattggctaggagtctggagaggctccctaacatggggagagaattagagatgcacaaaggtacacattcttgtacaagattcctacaatcctagccaattgagagcccttcaacccgtgtgggcccccaaaccaacacacagctgtctagatactgtgcaaaggcattgcttcacggaagaagcccatgctgggttccacaaactctagagtcctaagcagctgcaacatggcctggttttgagagcccagcccccaccagtctatgtcctgacctaggactaaaaatcttccctatctccacattcctggagtctcagtgatatttcccacccatggctgcaactgctggggccaaggcaggaaccactggcagcaaaccctcccctgcccaacagaggggtggccactcaacttcatgcacactgaagactaattccactgcctgcaaatgctgtcactgtgaactgctgtggagttgagacacaagcgacgcacaggctacccaggcaactgcttatggctgctcccaaggaaagcaaccttaccctctccagtagcagggccacagtgtagccaacactgccttccacctgagcattgcacaagggacctggggagcaccttgcccctcgactacaataaccagtggttgcatgcaccaccaggagtcctgaggacaggtcttcccagctctgctcttccaaatcccccagtacataaaaatttgtatagagacctggggctctcccaccccagtttaccaccattggcatctgactagtcttcctggggcctgaatttgggcccactcaagcttccactaccaccaaagctggcgtcaacctacatgcaccatctgcaggcctaggaactggcttgcccaatctgttgcatccaccaccaacaccatcatggattgcttgcattccagagggttgcccccctcccactattgccattacccgcaccatgcttgctgcccctgggctgggaacctgtgtacccacccagcccacctatgcttttcctgacaaccaagcaagccacctataagccaaagggttagcctgcctggacacactaacatcaatgccaatgtacacagctctgaggcctgaggacaggcacgctcaaccaactgatgccaccactggggcctgaagactggaccacttggtgtcccagtcaccggcaaaacttcaccacagcttctgctaacaactgcaccctaagctactgaggaagttacagacaccattcatactgtttacatccaaagaaatcatacaggaagtatactactatatacattcagaatcaaaggcaaagactcaagaggagactagataaaacagaagaatctcagaacatgaaaacaggtcttttaaaataacctactcaaacaaaaaataacaaaaaattttaaaaaaatgagcaaagcctatgtgacatatacaacaccataaagccatgaaatgcttgcattttttatgtcctagaaggtaaaggagaaactaaaggtttagaaaccctatttaacaaaataatagatgaaatcttcccaagtctagcaagagatttagacatccagatacaggatgctgaaagatctcaaaaagggatacaattcaaaaatgtcttgtccatgacacattatagccaaactctcaaaagccaaagacaaaaagagaattctaaaaacagcaagagaaaagcaccttgtcacttataaagaaacctccatcagattaacagtgaatttctcagaagaaaccttacaggccagagaagaatgagatgttatattaaacttgctgaaagaaaacaaccaccagccaaggatactctacccagccaaggtagccttcataaatcaaggagaaataaaatagttcctagacgagtgaaagctgtggaaatttatcaccatgatactggccttacaagaaaggtttaagggagtcctatacctggaagtgaaagaatgacaactaccatcatgaaaacacataaaaatataaaaacaactagtagtgcaaacacacaaaaaaaatcaagaaaagttactcaaatgttaccactaaagaataccatcacactataatgataatgagggaaaaaaatgaagaaaaaatattcaaaacaaccataaatcaataaaatgaaagaaataagccctcacatatcagtaataatgttgaatgtaaattgattaaacattccacataaaagacataaactggctgaatggattaaaaaatatataacccaaaaatattctgcctaaaataaactcatttcacctgtaaagacacatatagatttgaagtaaagggatggaaaagtatattttatgcaaaccgaagccaaaggggagaagcagcagctatgcttacataaaacagactttcagtcaaaaacagtaaaaacaaacaataaggtcattatataatgataaagggataagtttagcaagagtatataaaaattctaaacatacatacacccaacacgagagctcccagatatataaagcaagtattagatctaaagggagagctagatgcaaatacagtaatatctgaggacttcaacaccccactctcagcattagatcacttagacaaaaaattaacaaagaaacattggcttgaaactgctccttagaccaaatagtcctaacagacacttataggacaattccttcaacagtcatacacatttttttctcataagcacacagaacattctccaggacagaccatatgttatgacagaatatgtcttaacaaatttataaaaaatcaaaatcatatctaatatcttcttaaaacacaaggaaataacaaaaagagaaactttggaacctgtacaaaaacatggaaattgaacaacatactcctgaatgaccattgggtcaaggaagaaaattgaggaaatgttttcaaaaaattattgaaacaaatgaatatcaaaatataataacacctacgggatatggcaaaagcagtgctaagggggatgtatatagcaaaaatgctcacatcaaaaatgttgaaatatttcaaacaatctaacaaagtacttcaaggagctagtcaaagaaaaaaaaacaaaccaaacccagaattagtagaaggatgaaaatcctaaaaattgagcaaaactcaagaaaatagagagcaaaaaatacaaagtatcaatgaaatgagaagtttgatttttaaaaagatgaaaataaagcacttgctagactaaccaagaaaaaaaaaagactcaaaatcataaatgaagacggagacattacaactgataccatagaaataaaaagttcagagactatactgaacaactattaaataataaactaaaaatctagaggaatgtataaattcccggacacatacaaccaaccgtggatcaagaagaaatagaaaatctgaacagatctataattagtaatgatcttgaatcagtaatcttaaaaaatttcccaacgaagacagtccaggaccagatgtctttactgctgaattctaccaaactttaccaattctcctgtaagtgttccaagaaaaattgaagaggaaggaattccccctatctcattctatgaagccagcattaccctgatgccaaacccagacaattatgcaacaaaaaatacaggacaacatccctgatgaacactgatgtagaaattctctacaaaatgctagcaatccaatagaacataaaaaatgtaatattatcaagtggaatttatcccaatgatacaaggatacatcatacacaaatcaataaatatgacatattacatcaaacagaatgaaaaacagaaaacatgatcctttcaatagacacaaaagaacatttcataaaatttaacatcccttcgagataaaaactccaacaaactaggcatacaaaaaaaattaacaaaataaagaccatatatgacaaatctacaagtagtatcaaactgaatggggaaaagctgaaaaatttctccctataaaactggaatggtcaggcgtggtggctcacgcctgtaatcccagcactttgggaggcagaggtgggtggatcaatagatcaggagatcgagatcatcctggctaacacggtgaaaccccatctctactaaaaatacaaaaaattagccgggcatggtggcagatgcctgtggtcccagctgctcgggaggctgaggcaagagaacggcatgaaccctggaggctgagcttgcaatgagccaagattgggccactgtactccagcctgggcaacagagcaagactccatctcaaaaacaaaaaaccaaaaacaaaaaaaagaacaagacaaggatgcccactttcaccactcattcaacatagtactggaggtcctagccagagcaatcaagagaaagaaatacaaggcgtcctaatagaagaaatcgttgtccaagtactgctctttgttaataacttatagctagaaaaagctaaaccctcaccagaaagctctcagatctgataaataaatttagtaaagttgcaggatacaaaaatcaacatacacaattcagtagcatttctatataccaataatgaactggctgagaaagaaatcaagaaggcaaacctatttacaacggctggaaataatacctaggagtaagtttagcccaggagggaaaggtccgtataaaatacagaacactgacaaaacaaattgaagagtacaccaacaaatggaaagtcatcccatgtttatcggtcagaagaattaatgttattaacatgatctttctactcaaagcattctacattgaataatgcagtccctatcagaatacagaaatggaataaaaagtgatcataaaatttgtacgatcaaagaccagcagagagcctgaatagccaaagcaatcctgagcaaaaagaacaaagacttatgaatcacactacttgacaaaacagcaaggtgttagaataaaaacagacatatagaacaatggaatagattagagaactcagaattaaatccatgtatttacatacaacttgtttttgacaaaagcaccaagaacatgcattagggggaaggacaccttcttcaaatggtgctgagaattggattgtcagatgcagaagtatgaaactggatccctgtctctcaccatattagaaaattcagctcaagatggattaaggatttaaaggtaagacctaaaactgaaactacatgaagcaaacatagggaaaacagacaggaccttggtctaggcaaagattttatggttatgacctcaaaagcgcaggcaacaaaaacataaatagataattgggactgtagaaaatgaaagagcttctgtaaaacaaaggaaggattcaacagagtgaagagacaacctgctgaatgggagaaaagatttgtaaactattcagacaagagactaatatctaggaaatacgaggatcccaaacaatttaacagtaaaaaaataatcacattaaaaatggacaaaggacaataataagtatttctcaaaagaagacaaatgaccaacgggtatatgaaaaaatgctcaacatcactaatcattagggaaatgcaaatcaagtcatgatgagccatcatcttgccccagttagaatggctattattaaaaagacaagaaaacaacagatgttgacgaggtgcaacgaaaagggaactcttaatacattgttgtagttcagaatataagtcagtatagccactattgaaaacagtatggagaagatttctcaaaaaactaaacatagaaatagagtatgtgtcagcaatgccactaataagtatatatgtaaagggaaagcaatcatatacttttctaactatcaggaaaagtatatgcatggcatacctgtacttgcatgcttattgaggcactatttataatagcaacttaagtgtccattagtgaacaaatggataaagaaaatgtggtacatatatacagtggaatactcttcatccataaaaaagaattacattttctgcaccaacatgaatgaaactgcaggttattaagtgagacaatcgaggcaaagataaatagattttacattttcttactcatatataggtgtaaaaaaagttgttctcatggaaatagagagtataataagataccagaggctaggaagggtaggaagggaatataaaaaggggttatttaatgggtacaaatatatagttggaaggtatatattctaatgttcaacagcagaaaggggtgactagagttagcaacaatatgatgtacatttcaaagtagatgagagaactcaaaatgttcacagaacataaaaatgataaatactcaaagtaatgaataccccaaatacactgacttgaccattacacattcagtgcgtttaacaaaatatcacatgtatgtacatatatgtaaaacgttatgcatcaataaaaataaaagttctaaaaagagaataaatctaagaggatagcttattgctttaaaataaaatgacaagacaactataaatcttcaggtttccctctgcaaggaataaatcctattgtatgacaattaaatttccctcttataagatttaaatgacatcaacaaagactttagttcatcattattttacccaaatattgttgtaaaatagtatattttcatcttatatttcatgttccagctgtaaaatgtcacatgcattttatatatagaaattatttaattggaaaacatatgtaccaacctaatatctatttttccagtgcccagctttaaggtttttggatattcatttgcaggttctgtgatgtctttttttgtttgtttttgtgggatggggggacagggcctcagttcttttgcctaggcttgagagtagtggcacaatcatagctcaccgcagccttgaactcctggcctaaagcaattctcctgccttggcctcccaatgtgctgggattacaggtgtcagccatcacacccagccctgtgatatcacttataattatgtataaaacacagttaactccattttgaagacagtgaagtaagttttccaactatcagcaaaatatacattacattcaaatattatcactgacttaaaaccacatagaaaattttaaactacttatgccattttattctcatttaccatcattagaatggtcaaaatgtttttgccaaggcaaaattctgtgacaagaaacacagatatcaactatagaacacttttctgaatcaaacctaatatctcatgtattccttcatagctgaaataaaattaacaaataccaatagatgtttttaatatatttctttagtctcatgaactcattgtgatgatatgactaggaaaaccatccacaaagtgtctattacatattatttagcattagaacctcatggctgcatttctcattattaatttattaatgtcttgtcaatcattcaaaaatcacttaatgtcactgtataggccaaggatattgttatttcacctgtaattaaaaaaaaaaagttgtgaaaataatcctggtaagctaattgaaaagagattctcagttatctaggtaagaattatatttaaatgtttctgaacaaatttggcatagaacctaatccataatgcacatcttcaatcgcatgattatacttcattatttaaattccccaactgagtaagaaactcttacttaactaaagcatactttaacaaatcagcccctaggggagatagaaattataaattgaccattttccataaagttaaaatggtgacaaatcatagaagaatgtgaaagattagtagaaaataccaaaatttgttataaagggtaaattcaagccaggctcccgcacacacaaatatcatatttaatgtttttcaagtctctgttgtctaagtaggtgaatttgggacagttacatgcaattatttgtcatccaaacaactgaaatggataaggagaacaaaaattgctttcatttattagtgactggttccaactgcccagaaaatactcagtttttttatggtatctgaactgagaaagatgtacaacacataacatcaagagaacacactggaatactctcatgcctcttctaacttttaggccactgggaaataacatttacgtcttaatttttgtcatgaagagcaatttcaagatttcccatcagggaagaggaaattgctacaataatatctgaatgttaatataatcatctgtatcatacctatttggtatatattactttgtcatcaaaaaggcaatggccatttttcattcatgtaagtgccagtgaaatattttcttaaatattttcttaaatatattttcaactgcagagtttgactctaaattgtctgaaatatttacagtaaggatttctagttgaaataccgtatatagagaaggaacacctataatattgcaatcgcattagattttctgaaaacaaggtactctataatgagttctagacaaaaatcaatctaaatgatataaaattagtgtttatgttcacaaaaatatttatttatttaaattaactctaatcctcctgagaattaaccctctcaattttaacctgtgtaaacttataaacatttcttgccattatggtatcaaaatgtgatgattacagcagaggcggaaaaaagttaaaacagcccttgttcagccaattgatatcaaacccaacataagaggccttaaaaatattcttctcttttatagcaaattctatgtatctttccatgattatttttgtaggttaaaatcctgcatgcatacaaagccaagtctgaaagcattcactccaggagtaaaactttccaacaggcagagctaattcttggaaaagaaggctataaaaacaactcaagagtgatgcagggattagccaagcagaaaatagaatccgtgtcaccattctcaggaagtcaaaataaaggggattaaaaccaaaccctaacgggtttgtaaatgtcattttgaggatacaaaaatttctctcgagtcctagtgtccttccttttttggtcaaatttgactgtcattattcatttttgttctaaagttaccctggtaaataagtaagaacatttccatatcatatttcatatcctaaatggaaatggctttctacactaatattcaaaagacatctagaacaggcgcaatcttttatccctgattttttgttttattcctttaaagagaacatcctcactttgttattcacaggggaaagctgacaaagcactctcttaatatagggaggattttttttttttttttggactggcaaacaaaccaatctgtttgaaactcagagaaacaatgtatatgaaacccacgaccaacgcatgtagaatgtactgtcttacagagaaatcataacgggaagagaattgtctgattcacaaaaggatatttttaaagagatatacctattatctatgagcataaacatacataatttattaagtttaccctagatgtacttatttttgcatatgttagcatctaaacacactagaaacagctcctgaaatcgcttatgctaatgcctactgctactcattttaaaaggcaattccacttaaaactaaacctcaggcctcaaaacaccagttaaggccaaagcatatcaaattctatatatgaaatcctacaaggtttcaatgacttcctaattttataaagcaattctatcaacaaagcttatgtttaaaattgtcaaagcattatttggcaggtatttcttaaaccaaatatagcttcaatcccccaataataaaattctccccaaatgtttcattattctcctaaggggcataactaatttaaaatgaaatttctttggagagtagccaacatcatgcataagctacagaaccaatatctggttaaataaaaatatgaacatcacaaaagcaattactatacaggcatgaatcacgaattttgctggtaaatctatcgaagagagtgttctaagtctgagacttcaagagatggtgttctgtcttttgtgactaagcagtcagtaaataaaaattcttatgagttattatttttttctttgaatcatcattgagattatctcctgaaaaatgctgagcaaaaatgtataaatgtgtacttggtggtttccctaacacaatggcaagaattgacatattttaaaaatatatgacttatgctgaatcctcatcttatttgcagccataagtaaactttaagaaactttttattattatactttaagttttgggatacatgtgcagaacgtgcaggtttgttacataggtatacacatgccatggtggtttgctgtaccaatccgtcatctatgttaggtatttcccctaatgctatcactcccctagccccacacaccccaaaaggccccagtgtgtgatgctccactgcatccatgtcttctggttgttcaactccgatttatgagtgagaacatgccgagtttgattttctgttcctatgttagtttgctgagaatgatgttttccagcttcatccacatccctgcaaaggacatgaaactcatccttttttgttgctgcatagtattccatggtgtatatgtgccaaattttctttatccagtctatcattgatgggcatttgggttggtttcaagtctttgctattgtgaatagtgctgaaataagcacagaataatttataatcctttgggtatatacccagtgatgggattgcttggtcaaatggtatttctggctctagatccttgagcaatcaccacactgtcttccacaatgtttgaactaatttacactcccaacagtgtaaaatcattcctatttctccatattctctccagcatctgttgtttcctgactttttgatgatcaccattctaactagcatgagatggtatctcattgtggttttgattttcatttctctaatgaccagtgatgatgaacttttttttcacatacttgttggccacataaatgtcttctttgagaagggtctgttcataccctttgcctactttttgatggggttattttcctgtaaatttgtttcttgtagattctggatattagccctttgtcagatagatagattgcaaaaattttctcccatcctataggctgcctgttcactctgatgatagttttcttttgctgtgcaggagctatttagtaagatctcatttgtcaattttggcttttcttgccattgcttttggtgtttcagtcatgaagtctttgcccatgcctatgtcctgaaaggtattgcctaggttttcttctagggtttttatggttttaggtattacatttaagtctttaatccatcttgagttaatttttgtataaggggtaaggaaggggtccagtttcagtcttctgcatatggctagccagttttcccatcatcatttattaaatagggaatgctttccccattgcttgtttttggcaggtttgtcaaagatcagatggttgtagatgtgtggtgttatttctgaggcctctgttctgttccattcgtctatgtatctgttctggtaccagtatcatgctgttttggttactgtagccttgtagtgtagtttcaagtaaggtagcatgatgcctccagctttgttatttttgcttaggatggttttggcaatgcaggctcttttttagttccacatgaaatttaaagtagtttttttctaattctgtgaagaaagtgaattgtagcttaatgaggtaacattgaatctataaattacttcgggcagtatggccattttcatgatattgattcttcctatccataagcatggaatgttttttcatttgtttgcgtcctctcttacttccttgagcagtggtttgtagttctccttgaagaggtccttcacatcccttataagttggattgctaggaattctattctccttgtagcaattgtaaatgggagttcactcatgatttggctgtttattatcggtgtataggaatgcttgttatttttccacatcgattttgtatcctgagactttgttgacactgcctatcagcttaaggagattttcggctgagatgatggggttttctaaatatacaatcatgtcatctgcaaacagagaatttgaataccctttctttctcctgcctgattgtgctggccagaacttccaatactatgttgaataggagtgatgagagagggaatttttgtcttgtgccagtttttaaagggagtgcttccagcttttgcccattcagtatgatattggctgtgggtatgtcataaatagctcttattttgagacacattccatcaatacctagtttattgaaaatttttagcatgaagggtagtgaattttatcaaaggccttttctgcatctattgagataatcatgtggtttttgtcattggttctgtttatgtgatggattacgtttgttggtttctgtatgttaaactaatcttgcatcccagggatgaagccaacttgatcatggtggataacctttttgatgtgctgctggattcggtttgccagtattttattgagcctttcacattgatgttcatcagggatattgacctgaaattttttttattgtgtctctgccaggttttggtatcaggatgatgttggcctcataaaatgagttagggaggagtccttatttttctattgtttggaatagtttcagaaggaatggtactagctcctctttgtacctctggtagaattcggctgtgaatctgtctggtcctgggctttttttggtttgtaggctattaattactgcctcaatttcagaacttgttattgttctattcagggatttgacttcttcctggtttaatcttggaagagtgtatatgtacaggaatttttccatttcttctagattttctagtttatttgcgtggagatgtttatagtattctctgatggtagtttgtatttctgtgggatcagtggtgatatcccctttatcattttttactgtgtctatttgattcttctctcttttcttcttttttagtctggctagccatctattttgttaatcttttcaaaaaaacagctcctgaattgagttttttttttttaagggtttttcgtgtctctatctccttcagttctgctcttagttatttgtcttctgatagcttttgaatttgtttgctcttgctgctctagttcatttaattgtgatgttaggatgtcgattatagatctttcccactttctcctgtgggcatttagtgctataaatttccctcttctaaacacttctttagctgtgtcccacagattctgctacattgtgtgtttgttctcattggtttcaaagaacttatttatttctgccttaatttcattatttacccagtagtcacccaggagcaggtttgttcagcttccatgtagttgtgcacttttgagtttcttaatcccgcattctaattagattgcactgtgatctgagaggctgttatgattttcattcttttgcatttgctgaggagtattttacttccaattatgtcgtcaattttagaataagtgcaatgtggtgctgagaagaatgtatattctgttgatttggggtggagagttctgtagatgtctattaggtctgcttggtccagagctgagctcaagtactgaatatcctttttaattttctgtctcgttgatctgtctaatattgacagtggggtgtgttcaagtctcccactattattgtgtgggagtctaatacccagtggtgcctggaacgccagcgagacagaaccgttcactcccctggaaagggggctgaaaccagggagccaagtggtcaagttcagcagatccaacgcccacggagcccagcaagctgagatccactggcttgtaattctcgctgccagcacagcagtctgaagtggacctgaggctccagcttggtggagggaggggcgtccgccattactgaggcttgagtaggcggttttccctcacagtgtaaacaaagtcgctgggaagttcaaactgggcagagcccactgtagctcagcaaagccactgtagccagactgcctctctagattcttcctctctgggcagggcatctctgaaagaaaggcagcagccccagtcagcggcttacagataaaactcccatctccctgagacagagcacgtgagggaaggggcagctgtgggtgcagcatcagcagactaaacgttcttgcctgccggctctgaagagagcagcagatctcccagcacagcactggagctctgctaagggacagattgccttctcaagtggggccctgacccccgtgcctcctgcctaggagatgcctcccagcaggggtcgacagacacatcatacaggagagctctggctggcaactggtgggtgcccctctgggacgaagcttccagaggatggaacaggcagcaatctttgctgttctgcagtctctgctggtgatacccaggcaaatagggtctagagtggacctccagtaaactccagcaaacctgcagcagaggggcctgtttgaaggaaaactaaaacagaaaggaatagcatcaacaaaaaggacatccactcagaaaccccatctgaaggtcaccaatgtcaaagatcaaaggtagataaatccacaaagatgaggaaaaaccagcacaaaaagggtgaaaattccaaaacccagaacacctcttctcctccaaaggatcacaactcctcaccaaacaagagaacaaaactggatggagaatgagtatgacgaattgacataagtaggcttcagaaggtgggtaataaactcctccaagctaaaggagcatgttctaacccaatggaaggaagctaagaaccttgaaaaaaggttagaggagttgctaactacaataaccagtttaggcaaaacaataaatgacctgatggaactgaaaaacacagcacaacaacttcatgaagcatacacaagtatcaatagctcaatcgatccagcagaagaaaagatatcagagattgaagatcaacttaatgaaataaagtgtgaagacaagattagagaaaaaagaatgaaaaggaatgaacaaagcctccacgaaatatgggactatgtgaaaagacaaaacctaagtttgattagtatacctgggaaaacattcttcaggatattatcccggcgaactttcccaaactagcaagacagcccaccattcaaatttaggaaatacagagaacatccacaaaaatactcctcaaaaagagcaaccccaagacacataattgtcagattcaccaaggttgaaatgaaggaaaaaatgttcaggacagtcaaagagaaaggtcggcttacccacaaagggaagcccatcagactaacagcagatctttctgcagaaaccctacaagccagaagagagtaggggccaatattcaacattcttaaaataatttttaactcagaatttcatagccagtcaaactaagcttcataagcgaaggagaaatagaatgctttaaagacgagcaaatgctgagagattttgtcaccaccaggcctgtcttacaagagctccttcaggaagcactaaatatggcaaggacaaaccagtaccagccactgcagaagcataccaaattgtaaacaccatcgacaccatgaagaaactgcatcaactaacaagcaaaataaccagctagcatcataatgacaggatcaaatttacacataacaatattaaccttaaatgtaaatgggctaaatgccccaattaaaagacacagactggcaaattggatgaagagtcaagaccaaatggtgtgctgtagtcaggagagcaatctcacgtgcaaagacacacataggctcaaaataaaaggatagaggaatatttaccaagcaaatggaaagcaaaaaaaataaaagcaggggttgcaattctattctctgataaaatagactttaaactaacaaagatttaaaaaaaacaaaaaaagacaaagaagggcattacataatggtaaagggatcaatgcaataagaagtcctaactatcctaaatatatatgcacccaatacaggagcacccagattcataaagcaagttcttagagacctacatagagacagactcccaaacaataatagtgggagactttaacaccccactgccaacattagatcaacgagacagaaaattaacaaggatgttcagtacttgaactcagctctggaccaagtggacctcacagacatctacagaactctccaccccaaatcaacagaatatacattcttctcagcaccacatcatacttattctaaaattgatcacataattagaagtaaaacactcctcagcaaatgcaaaagaatgaaaatcataacaaccaacctctcagaccacagtgcaaacaaattagaactcaggattaagaaactcactcaaaaccatacaactacatggaaactaacaatctgcttctgaataactactgggtaaataacagaattctgacagaaataaagaagttctttgaaaccaatgagaacaaagatacaatgtgccagaatctctgggacacagctaaagcagtgttgagagggaaatttacagcactaaatgcccacaggagaaagcgggaaagatctaaaatcaacaccctaacatcacaactgaaagaactagagaagccagagcaagcaaatcaaaagctagcagaagacaagaaataactaagatcagagcagaactgaaggagacggaaacatttaaaaaaaaaaaaaaaaaaaaaaaaaaacatcaacaaatccaggaggtgtttttttttgaagagattaacaaaatagactgctagatagactaataaagaaaaatagagaagaatcaaatagacacaataaaaaatgataaaggggatatcaccactgatcccacagaaatacaaactaccatcagagaatactacaaacacctctacgcaaataaacaggaaacctgtttaagcgataagatgctctttcaattggaagagtctatatatagaaaggctttacagatatgagattttattgggaaaacgagaccataagcagtggctggatcttcattaatcagcctgtatttcatattacattttgttgattttaaattgttgaagtttgagacagtaaaatggtgatcttataggatatacaatgtacctttctacatatacttcccacttaggagagcatatggagttaggtataccaggctcttttagctataaaatacactattcatgtacctgcctttttctgattacaggctcgtcaacctactttttaaaattgtttttattcatttaaattttttgtggatatatacataggtgtatatatttacctattttctgattatgatgtggatgcccatttaggcactcctattctgtaagttcaaaggagcactagaggtcaaaagccattttgtcacttaataagaaaaatatctatttttaaatcttctcttactgttttatgaaaggataggacacacacaagaataactagagcatacaccccaataatgggaactgaccatatgtgattcaataaaaaacaaacatattaacagccttatctttcaaattcatacagtatagctctttatcctcagaggttgaagtccgtattttcattatgtctgccctttctacctcactgaactaagagaaaacatacaaatgtgtactacgagtcaatagtaaagtaatcctcccctatactgcaaactaaggacgtaggattaatagtttctcccttagagctaaaaacaggggtaggagggatactatcgtgtatagaagcaataaaaaggggttacagtattcagtgttcagccatgcattatccaaaggagaagaaacatttcaagtcaacttaatctgatcccaacttcacaaactaacatttttgttgtaatttgctttcccaagtacatgtgcttatcaagagcaatatatttgtcaattgtatgtgaatattctgctgcttgttatatctcatttaagattactgaatttccatttttatttatatatcactttttaaacttaaagttaactcctcccaccccaatgtggatctgctagatgatctgaggcaatcaggcttctgcgtctgcaaaactgagtactagattctggttgataataaattcactggcaaaaggctgtcttctgggtcatttttgagttttcttgatgggacctaccatccatattgaaagatctcctgttttggaattgatgaaatcgatttaatattcccaaaagcatttaattatcagcttctattgtagaacagcttctacccaaatatcatcttcaatcccaccgatttcacttttccaactcctgattttagagtgtagtaaagccttgagaattgagaacagaggctaccatttcaaaattggcatggcaaaaagtgtacttcataggctagaagaagagtagaggtcacagtgttattatctctgtaatctctacgtctggaaggtatgactatgtagcaccagagataagagtcaaagttattgaagtgtaatgtaataaaaatataaatacacttctgcctatcaactaaagaagcagaaaatgagtaaccatccaacagaggatctccccagagtgaaaaattacaacagaagtagtggcaggaatagatttcctgatttaaatagtaaaccatgttgccttttatagagtatatgaatgaaattggcaagagtagctaattaattatagctgattactctatcaaatctcttggtagcataagcaaaacattaactttttataattatttggagtcaatgcactccaaatgcagtatgctccatccatagggcatacacattttaaaggcttttttcctaaaagtcttcactgcaattttagatactggtattttgagaactagaattaaataagacaattcataatatagtgcaagaaggctgaacattttaaatatatctacagtattggaaaacttaagatatgtagttttgtattttgtgtagaaatgacaagtctcagatgaaaacattaaactctaccatactaaaagcagtggtagtccagaaatttaccaaccttcaggatcgagtagtttctctatgcctaattgatatctggcgatgttgaatgcatgttccagtcgttgtgtggctgactgctggcaaaccacactattccagtcaaataggtctggcctaaaacacatacacatacacacatacacaaagacaaatataaatcaatctagaatgttccatgagatttacttccatgcttaattttcattgacaaccaatgcccatagtccttaagtcttgagtgtaattcatttaccctttaaaatatttctatttaaacaagtaataattttaatggaagatctcattgggtgtggtggctcatgcctgtaatctcaacaatttgggagacggaggtgggcagatcctttgagcccagaagttcaagaccagcctagacaatttggtgaaaccttgtttctaccaaaaaaaaaaaaaaaaaaaaaaaaaaagaaagaaagaaagaaagaaagaaaaactagctgggtgtggtgtcacatgcctacagttccaactactcagaaggctgaggtgggaggatcacctgagcccagggaggttgagggttcagtgaaccataatcgtgccactgtactctagcctgggcaacagagtgagaccctgtatcaaaaaagaatgctgaggatgtataccttaaatacatacaacgtttatttgtcaattatacagcaataaagatgtggggaaaaaagaaaatcctgaagatgacaaataatctacgctagcttatccaagcaacaaaaatttatctatctcatccagtctcgtggatttcaataccagccatttactggtaatgcccagttttatatgtctaacccagacctcttccctaaacttcaaattatagattcttctaaacactcattatctccatttagtaatcacaagcttcaagtgtcctgaactgagcttctgatgtttatcctcatcatactcccccaaacctacctacttttcttgctgttctcccttcctcaataatgaacaatgtgtttaaaattgcagttgctcagataaaaacccttggagtcatccttaatgactattttactctcacacaacatttaattcaaaatgtattcagaatttgactgcttctgactatcctcactgccatcactctagtccaaaatccattttatcttgcatgaattatcacaatagcctcataactcttctctcactcttgcctgcgttaattagtgcatagcagagttgccagagtgatctgttaacatgtttcatcatatccgtcttctcaaatctctgctttaggggaagtacaaattacgtatttcatgtgatctacgaagtccaacagggtccaggtccctattaactctctgattttatttcttgtctctttcctcatattccataaacaggatccatagtttcctgcacttggatttggaattcgcttttcgaagacataaacatggctcactcctttacttccattgggtctttactcgaaaatcacatcactgataagttcttccctgcccaagccctatctaaaattgcatgctggccaggcaccttggctcacacctgtaaaccaagcactttgggaggctgaggctgaaggatttgcttgaggccaggagttagagaccaacctgaaccacatagtgagacctggtctctacaacttattaaaaaaaaaaaaaaaaaatagccaagtgtgctggcatgcccctgtggtcccagctactcaggaggctgaggttggagaatcacttgagcctgggtggctatagtgagccatgattgtaccactgcactccagcctgggtgactgaggaagaaccagtctcctaaatagataaatgaaagaaaactgcatgcctcaaatcaaactcacatatacttattttctttctccttatctgctttatactattctcattaacacttactatttaacgtattatataatttaattaaatttctctgtgtatctttctcttccactagaatgtacaatcttttattgcctattttgttcactgctggaaacctagcctgacacaaaataaaggctcaacaaatatttatcaactacacgagagaatggatgagcacatgaaacttacataccatgttacttgataatagagaaaatgcaaaggagtgtaagaggcagttcttgtcttataaggattttaaatttaatgagcaagaaaaatgaagaagccatatgaattaattaaactctaaatgtgaaaaaacacagacaataagaaaatgttttgtaaaatctgaagcggtcaagaaagttttctgaggctgaaagacagattaaatagacgtttcgacttgcattaaaaaaaatgtattgataatagaattctaagttgtgtgagcgttagagaattaaagttcttagggaaggaaaaaagcaaaacatgctcagataatcaagacctcacaggcctggctccattggaagattctaagtatcaagtggtgggagataggtttaaaagaaagaaactggctgagtttgcataaggtgttggctgttaacgtattataatttatcccaacagcactggaagtcattagtcaagtggttcttcacctattctgaatcacagacacctttgagaatctgttgagagctatgaaacttctactcctacaaaaaaactctccatatctgtgaacagagtctacatacagttttagaatatttgaatctattaatggactcctgtttaagagctcatgctatgcaaaaacaaaaaaacaaaataacgaaaaaaacaaaaaaaaagttacaaaggtagtttagctgttatttttctaaaactgtaattcaaaattggccaggcgcagtggctcccgcctatactcccagcactttgggaggccgagacgggtcaatcacctgaggccaggatttcgagaccagcctggacaacatggtaaaaccccgacactactaaaaatacaaaaattagcagggcatggtggctcgtgcctatagtcccagctactcaggaggctgaggcagtagaatcgcttgaacctgggaagtggaggttgcagtgagccaaggttggcccactgcgctctagcctgtgcaacagagcgagactccgtctcaaaaaaatacataaataaaggtataggtttattggtttcttcttaattgcttctactctagttaatacaccagaatttttacaattattaggaaatcgaatccctccatattttccaatacccctaacagctaacaagcttatggaaactagcttatttacaaattggataatgcctttgttatgaaaaatatataaaaaaatttaaaaattgtagaatatttaggggacttttaagttcactatgcgcactctgccttatcttcatttttttctgtaggcaatgggagtaaaaaaaggacataggtgggaacatatgagaaactagttttctcatctatggcatagtatacaaggttaaattgagtatgatgagaaaaaagagcattgcttatgcattcgtgctgtattcccttgtcttaccttccccatttccttggccactaactaaccaactgagtgtgtggatatcttatctaagtcatataatttatttgagctttggcattctcattcaaaaagcattgaaccaaaaggcctttgaggtcacgtctagcattaaaaatgaattgaattcttttatactattaaaattaattaacattttaaatatctatgactttcaaatgcataaaaattgtaaaactaaccaactatgaaggaaacccacacagcatttaatgttaacctggaccataatttattgacttgcaaccaaggatcaccagatttttaattaaatcaacaccatgattaggatagtgtaaatttaaatcctagctctaccacatgttagccaaacagttttaggtaaattacgtaacctctctatgactcaatttatctatttgtgagatgggtaaaatgacagcatctacgtcatggaacttgattgaatattttacctagaacggtgtctacaaaataataattgtttaaaaacattcgtttctattattttgctgtaatgttaattacatttatataagaagagtgatgtattttcaatttacagactcaagccaaaaacacctatctttacagaactgatataaatgttacaaatactactgatgcaaacagaatgtaatccgaaatgggaggtggagaagaggcgagagtaagaatgtgtgatgattttctcgtttttcatattggtcaaaagttcctttctaaacttggtaaaaatttaaaatgaggtatactcataccatttaatgtaataaaagcaaaaattacaactataaaatgattataagtaataaaattaggaaatacctggggatgaaacataatatggctggttttcatactatggagtaaatacctatactgttagaaattagtttgtcaacaagtagaaacattatcacacatattattataaccagcaggaaccaaagtacaagtagctgacagtgactgcatctaagaattgaaataaggtaagttaagattggggtcatgaagacacattgtgtttctgttttccctttgctcctgattctagtgttcatttgcttctaatttgctgtggtaatacactaaaataaggatttaggaagacaattgtaactttatagttattgtaattttatctgcatcttttgtacatatttctaagcaattatcattgggttttaacacaaaaagtagaaatctggcttcctttgaagggtattgtagtggactttgcgttttatcacacaacttttaactgccatgacacttagtcaatccttatgctctatattaactacatgtctttgttctgtatagttgaaccactcaattattgaaatgagggcacctcatgacattcctaattgtgccaacgacaatcgctatggaacagagagttcaaccatttttttctttagataaagaatatgaacatctgccaaatacaaaaagaagggggagatgattcatgaaagaacattaaacaactgtgaagaacctcttgaaaagtaaccatgtaatacataaagagagttactgatgattcatccaatatgacaggagagagtatataaatgaggatattttgacagagaaagagtgggtcagggacagataaaacagggcaatttgggtatgtttactgtattacctacaaatgtattcagaaatcattaaatagaatattaacaaatatagagtgggaacatgcttgcaggattgaagtcttccacttgaagggaaaaacgttagagagccaacaaggaccacataacctgatccttgatatttttattcatctgcaaatgtgtacatgaacagcaaaatcaatattttcgggcccttagtgttaagcatgtggctgcataaatgagcattgacttaaaacacagacagaatgtctctatcccttctcatctaactgtattgaggctgtggaaacattttcttctgtcatacgagaaacaatgtgttaacgctgcttaacgtgacatttgaatgcatgtctgcctctgttctaaatcaggttgctgagtaattcacctggaaacccagtcgggatggggttaattaaatccagctggagcaagacacctgacaaagatgcttatttgaaatgtgtttgctcttggactgagctttaccttagagaaaattaatattcttagcttttctagaagcaggattggcataggaaaatggtagagtggtcaaaaaaaaaaaaaaatcaaagtgagaaaacataacttgcactgaaaattaggcaagatgcagtccagtgacattttaaacagttaattaggcaatgcatttagccctgggttgggtaaatgaaacgggtaacaggaagaccaaaataaagtgactgtagtccctctctctcaaatacacacacacaagcatatatatatatatatatatatatatacacacacacacacacatatatatacatatatagagtataaatggtgtagtatatatggcatatagtatatattgtatctctaagtgtatgtgtacatatacatatgtatttcctacactgctttgctttttcttgaactgttattaattcatttactgaactttacacaagaaaagcaaaaaaaatctttttcatcttaagaaatataatgttgaatggaatatagttaaggactttggttcactgtattacagtgaattctttttattaaaatccacaaaagatctctctcttgctttatagcaattgatttgctgttccagtgcaattgtttctgttggtattcaaaacattgtgtcatataattaattgtgttctgctctttgtcttggttactaaaaatgctctgagcatcttatgaccctgaactagaacaaagtatacagggctttatggtgtttgatatcaaagtgtgtatctgataagacagatgtttctttctccacactacgtatctgatgatggtaattaatttaactacaactactcacatgagatctagtatcatttttacctgtatagtttaggcttatacaaacacattatctgtataaaaagaccaacaccattctcggcaaagttagaatacaacctggatttactgggattcccagtgtcaaacatattgatactctccccctccactataaccactttcacgctccgctaatgttaatgtttcaacaactgaattatatgtatcccatagaacactggaaaatattcttaattagttcattccaatggaacgttagatcaatgtggtcaatgtacataacatgttgtaaagtaggacatgatctggaaccatactggggaaaaatatgtcatcagagtctaaatcaccacttttacaagttatttaatgtctcagtaatcttcttacctatgactatggatgagagcattcaaagccaggccatcagaccagctggtggtgaagttgattacattaacctgtggataattacgagttgattgtcggacccagctcaggagaatcttttcactgttggtttgttgcaatccagccatgatatttttcattacatttttgacctacatgtggaaataaattttcataagaaaatgcattccttgagcaagaaccatgcaaacttaaatatgaatgtccttgatcttcagtgataaatagaaattttagggccaattagtaatgagacataatagattctaccagaagttaagtctattctcaaaggctaggagtctattctgattcattggtatctatgccataccatttactgaatgtgttcactattactcctggattctgccatattagacccaacatttactgtttatagaattgctcaccttctagctttcaatgaacaagctagagaagacagtgtataaaacattagacttattgttaaccaaggacttaagatataaaagcgctttttggataggaggaatactatagataattgttttttaaagtatatgttcaaattttgcctttgctattaattgtggtaattggacaagttgcttaacctcttctaggcctcatttctgtgtatcttacatgcaaggttagtgtaagatcaaagtacaaaatatggtcagataaaacccctgatttcataccatcatttaacgcaagctatatttattggctgaactgaaaagaagacagaaatgtttgcctacctaaaataaagaaaaaaaacaacaaaggaaggaaatatttatccctaagaggtgtacatatgtagccttggttctattttcattacttggtttccatgtatttgattgtctcataggcttcgtgcatgtgcagatgttattcaacagattatcaagtttaattcttctgagtcatctgatgcagaaatccattctaagcattttttctaagtttcatgaatgcagtgacgcttcatagaaaaaactgtctacatcttttattaaagaattattatttattaaagactgctttttaaatataagccccttatgagatgctggaagaagacatctatgtaaaagtgatcagtctgtaccactaagcactttccttctgggaaggttaaggttcatatactatcaacatttgatcagatgatgaatatttattgtgcattctaaatatgacaattttattttttcatccatatagaagttaacaaatgcctttggggtaaatgcatattttaacatctccaatgttagtcatctttttattaaaaagtaaatgcaaattttaggatatactactaaatctcattttaacatacttttaaaagatttgagatgatgctttgtaaacacagtaacgattcggagatatgaaatctttgcatgtatctgtcacaatcccttgataactaagcctattatttaggagtggattatccaagttttcctaattccttcttgacctacttatttagtcagttactcagtgaatacaggtcaaataattacgtaatttgtctcatattctaaaattataaattgctcaacctttatgtacagtgactgcaggaggtgtattttgtgtcctgtgctaaattacggttggaatcagcagatagtggcttaatggtggtaatggatttgcaataatcaagcaatcctccaatgatgaatgtgattcatttgtgaaatgcttggccagtctgccctctatgtgcataacgttaaaggacaacaaagtattcaatccaaaactcctttatagcatcattatgtcactaattcagcttatcagcctcagcctcgctgttattgcttctacttaggtgcaaatgttgctcagacaaaaaaaaataataaagggcaatgtatgataatcatgtctccttttcctacataaaaggcagttatcaaaaaatcattgagctggtccccaaaggtgagcctgtaaacagaaaactgtcccgtcctcaggtctcactgtctctaaaggaggctcaatttaaacagatgtatttgtgtgtgtgcgcgcatacaactataaatcaatttttaaaaggaaaaaagttgaaatgtctttgagcagtgatttttaaaaatgactaggagttaactgggccaagaaggcatgatggacatggaggtgcaccaccaagattgaccttcaaggaagggcttgttgctccagctgtggtcaggcagcttctagttgttagttctctcaggtaccacctgagttgcagagtcctgccagccaatgtcacaccctctctagggcaacccactactattgactgatgaaggggcagagtataaacactcagccattttaaccccatttgagacaactctgaggggtcatcctagctgcaagttgtctatggggtttgaataagcgtgtcatagggtctacgtcacagctctagttcttcctctttccactcctgtcacctctgcccttctacaggtgtttttttttttttttttttttccagggcatggcttaataaacatgctgcctgccaaactcaactccgaagtctactccccagaacccagactgtgattaaaagaagttgcagcagaggaatagaaatgaagagggtaggaataatcttatatggtaaggatagtttctgtgaagctctgcagaagagcagagcaagaactgtcttgcacagaagtgacttggtaggcaggaatttacagggatggctttcagcagtgcgaacgtcatcattctcctgtaattgcaaattgtatcaataatatgaacattctaaagtgaattagcgttgccattaagtacatcccttgaattgtccagtaaaagtatggacctgacttctgatagctcaccactgttagcaagatttgttattacaaccagctggttgccagagccaagtttagcactccgaaaaaaaaagaattgcacttaagaaggaagaaaaagatgccaaacacatgttatatgctttgcaattttgttcaaacctgcctatgttacaaaatatgcgttactgttttaggctagcaattttatttgagatggacagtagaaaaacagtaataggaaaacagagtttgcattcctgagttttcacaagttcaatgagaagtcctccatggcactattaataacatagtatgttgcattagaaaaaggggccaacatggttctatctgtaaatgccgctcgttatctgatagatctagaatgtacattaagttgaccaaaatgtcctttaatctttgctgaaattcaagggcttctaccatttaataggaagaaaatatgtaatgttggtgtaaaaaaaaaaaaaaaaaagaaaaacacatttttagattcactggattatgatgaacactgagcaagataatttttcaaagtgtgcttaatagttttagaacagggcagtgtgatataagagagatgagataagtaagcagaggctgggaagagtctacagtcttgcagtctcaaggatatggtgattcaagggcataaatgaaaaacaacaggctataagagaggtctcagacaaagaaagatttaaaaagcattccttctgatattcctcattgcaaaagcgcctccacatgctaataatgaaaaatgggctgggtgcggtggctcacgcctgtaatccaaacactttgggaggccgagacgggcggatcacaaggtcaggagatcgagaccatcctggctaacacggtgaaaccccatctctactgaacaaaatacaaaaaattagccgggcgtggtggcgggcgcctgtagtcccagctacttgggaggctgaggcaagagaatggcatgaacccaggaggcggagcttgcagtgagcagagatcgcgccactgcactccagcctgggtgacagagcgagactctgtctcaaaaataaaaaataaaaaaataataataaatgaacaacttgcaagcaagtgaagaaattatcagacataatagtcttgaaagcttatcttggactagttcagatggagttggaaagggcttcaggatatttttaaaaatggtaagatcatataagaagtagtataaacaataaatacagttcagagtgccttttggagctctgtgcatgcttgagttcttctgctggctttgtcaaaacttacatctgtcttacgcaaagcgggatctgcaaactggattcactctaggaattatttgttactatgccataagataaagtcaacaattcagagtgcatcaagaaacttatgtagcgattttacagagtaccatttatgtctaatgtatttaataataaaggaggaagcatgggtgttgggcatcttatttttgtaacgctttggttttattctatcttacatacaatggattaggggaaaagtgttccttcctcaagatattttgagaagtactgagcaacatatgaaaagcagtttggggagagatgcggtatgttgcttgctggttctatttgacaccatcactatatggaacgggctgaaaatcggccaacttgggctcacttaaggctcctatgagctattctttgttgccagcacatattaattcccgctctttctcttcccctctccccgcttactgttgtgaagtagcattaagcctgttcagagaatttggaataaaaatatatgggggccaattaggagagcaacatggctgctgaatttaataggtactctttgtgtctactcactatttgactctgagcaagagcaatctacaattcaagttaaaattcaagccgggcgcagtggctcatgcctgcaatcccagcactttgggaggccgaggcaggaggatcacgaggtcaggagatcgagaccatcctggctaacacggtgaaaccccgtctctactaaaaatacaaaaaaaaattagccgggcgtggtgggggggcgcctgtagtcccagctactcgggaggctgaggcaggagaatggcgtgaatccgggaggcggagcttgcagtgagccgagatcgcgccactgcactccagcctgggcgacagagcaagactctgtctcaaaataaaaataaaaaaaaataaaaataaaaaataaaaaaattcaagtttaccgaatgaagccatgatatctgctacaatagggctggatctgaactattaccctcattgcaagaagccagacacaaaagaacatgtattatattgatataaaatatccaaaaaggcaaatacatatggacagaaatagattgacaattgcctagggctggggtgggagtgaaaaatgactgtaaatggagaagaaacttctttttaaggtggtggaaaagtgccaaaattagatcgctatgatggctatataactctgtaaatatcctgcaaattttaatgaacgtggtgggggggagttattcatccctcaaaatagtttgagaggctaccaagaaccagaactaaaccagattgatgcaaattgaattttacacttagaatgagtacattgatggtctaacaattacatttcaaaaacgctgatttataaaaaagtaatcccgaccagtaaaaacagcagtcatttctcagcctccaaattttttaaatgagtggaaaactttaagcaatcaatacaagtcatatgatacacctcaaataaaagtggtatactacactgagtgccttgcagatattctcccacttaatcgtgataagaaatacatacacatttatttttatttttactcttttgatagtgaagggaccatggcccagaacaggggtggcaatataccaaatgccactaagatggtaaccgtggaagtttaaattcaagttcatgttggtatatatatatacacatacatatttatacatatgtgtataacgagttactattacgtatatatatacaatgagtggaaaatattagtggatataagttcatgtatgattatgtatacatattatgattatactattatgtatatgtatacaatgagtggataatattagtggatataagttcatgttggtcttatatatacatatataatgtgtggatatgagtgtgtatatatatacatatataatgtgtggatatgagtgtgtgtatatacacacatgcatattgtatatatgtgtgtatatatagacacattatatatatacgcatatatactacacacacacacacacgggtgtgtgtctgtatcttttccacaaatccttcaacccattttgcagaggtcaaatagacagtcggaagaccctatgctcaggtgacttaaaaataatttccaaatcacattatggagtttgtatgtattacacacatttattgatagagatacccatattctactaatcttttattggcaataatttatgttaagaatacccaagactgagaaagcctcattcctttggtagtgattaaaataaaacatactaaattaacttatagacaagttatagaacatacatttgtgaaaaaaattactcacctatgattgggactttgtatttttaccttatacttactcaatgaaataaaattttgaaaaatattcctgtaaatgtaccagaacctattttataccgtgatgatccttaacatttcagacgacatggtagtgtcaatttaaaaagcagcactatggagcagggtttgttattgttagaaatacacatttgtttcacacgtcaagggtaaaaattaaaaaacaagattaatgttacccaaaaggaaaccattcatcaggattcttacctgccagtggaggattatattccaaatcaaaccaagagtcagtttatgatttccatctacgatgtcagtacttccaatattcactaaatcaacctgttaaagaaaggggtaaaacatttgaaggtaagagaccaaatgcctagttgcaataataataataataaaaacgtgaaggtaattgcatttagctattttcagagacttagcattgaagctttttgaaaataatctaaaaattaaacaaaatgcatgtgtaaaatcactttccataacaaacaagcaccccaaatatatttactttcagcacatgaatagattactgcagattaaagaggtcaactggagtatctccaaataaaatgtcataaagtatgtttaaaattaagatatgctttctagtatggaattacaactcagaaaaattcaccagtacttccacctagctccaaggagtgccattataattaaggctgactgcattttagtaaaacgcctctgttttagaatgaatgttaggtctctaataaacaatggagcaaactgccagctctcttatctctgtctaggactgtgtttggaaatgaaaatctggcagggttttatttgccttaatcaaggcaaatctctgtgtctcctgtccttcacactcctcaaatgtttaaggtggagtaaagttaaacacaagcatctgaaaagcaagcatatgaaaagatgttcaatgtttttagccaatagaggaatgcaaattgtaaccacaataatgtatcactgcacatttatcataatggttaaaattaaaaaatagtgccataaaatgctggtgagggtgtggagaaactggatgactcaacccctgctagtggaaactcaaatgatatagccactttggaaaacagtctggcagtttctcacaaaactgaacatgtacttattatacaatctggtaattgggctcttgagcatttatctcaaggaaatgaaaacacatgtgtacacaaaaacctgcacctaagtgttcatactacgtttatttgtaatagccccaaactgggaacccagatgccctcaggggtagataaacaaaccatagtacagccacaccatggaataacactcatcaatgaaaagaacaaactattgatacatgcagcaaattggatgaatttcatgggcattatgctaagtggggaaaaagtcattctgaaagggtagcatactgtatgaatccgtatctatgagagtcttgaaaagacaaagttacagaaatagagaacagaatagcagttggcagaggtcaggaatgggagtaagatgtggggtagctgaatgttcttataaaagggcaatatgagggacccttgtaatggtggaactgttctgcatattgactctgatggtggatttacaaacctacacacgtaataatgttgcatagaactaaatacacacatatgcatgcacacatacacataaatatgagtaaagctgggaaaatctgaatactattggtggttttatgaatgttgacatcttggtcatgatatcgtattttagttttataagatgttactacatcgaaggggagattgatcattcaagaataagaaagcatcatcatctgcatcatcatctggggattcctcatatggcagtagaggagagaaattcctccataaggaaaagccactatgaatttatctattgattcattgattcactaactcaacaagtaccttttggctatctgccaggcaatgaagtaataagagcatgtaaaagtaaaaaccttctgctttcatgaaacttaattctagtgatagtgacaatcagatgatatagcactaaagactcaagcagttaagcagagaatatgctatttttaggaaacatactcactcatactgcgggaagcactgctggtagatacgttttgggttgccatggacctgactctggggagacttagatcaagtaataggaacttagattccagtaaccccttatccactgtcataagacttgtcactgtgtaagcaggaagatagttcctccatttccttgtcctcataaaaggtctcataaggtccaatttccactatattcaggtactgggctcagacctgataaaggaaagtaaggtactacccccccagtgtcaaaaagttcacaacagaaggtcacataataaaaaagtatctaccattaggctctagcaattctacctctatgtttataaccaaaataattaaaaacagagattaagatattggtagaccaattatcatagtaacattattcacaatagccaaaatgtgagaacacccaaatgtccatctacagataaatggataaacaaaatgtggtatgtacatacaacggaatattttcagccttaaaaaggaatgaaattctgatacaaactacaacataaatgaaccttggaaacatatgctaagtgaaataagcaagacataaaatgacaaatattgtatgattctacttatatgaggtacctaaaatagccaaattcatagagaaaaaatggaagttattaaaggctaggggaggtgaaaatggagagtaatcgtttaatcagtatgaattcaacttgggatgatgaaatcattctagagatggatagcggtgatgactacccaacaacagaaatatacttaaagccactgaattatacactaaaaaaatagaaaaaatgatacctcaaaccctatctagggcaatgaacctgaatagacatttctcaaaagaagacaaaccaacggccagcacataaatgaaataatgttgaacatcactaatcatcagagaaatgcaaattaaaactacaatgaaatattacatcacacagaatggctattatcaaaaagacaaaaggtaagttgtggcaaagatgtggagaaaaaggaatctttgcacagtgttggtggaaatgtaaattattgtagtcatgaaaaacagtatggaggtttctcaaaaaattacaaataaaactaccatataattcaggaattctactgctgggtatatattccaaaggaaacaaatcaatatgtcaaagaaataactgcacttcaatgtatattgtagtgctactcaaaatagcgaagataggaaatcaacttaagtgtccatcagtagatgaaagaataaagaaaatgcaggtatacagacctacacacacacacactggaatactactcggacttaaaaagcagagaatcctctcatttgcaatgaaattaatgaatctagagtacgttacgtcaaatgacataagccaggcacagaaagacaaacattacatcatgtcacttgtatatgaaattttaaaatgttgagctcatagaattgagagtaaaatgttggttagcaggggatagagcttggaggaggagggttaggcagatgttggtcaaatgatactaaattacatttaataggaataaattcaagagatctactgtacaacatgctgactttggttaataacaatattgtattttgaaaattgctaagagaatagattttaagtgtcctcaaccccaaatgataaacatataagttaatgtatatgtttattagcttgaagcattccacaacatctagatattttaaaaaatcatatgctacatggtatatacaattttttttgctaattaaaaaataaaaaatagttatatggtaaattttacatcatttgtattttaccacaataaaaaataagtcattggaacacacatcgcaccccccccccacacacacacacacacagcagcagccacagataatacctaaataaatgttcatggtttttttccaataaaatttatctatatccacaggaaaaacaattaggtaggcaactgtgtctcacggaagcccaaggggtaagaaaaaggaagtaacattgtgaaaagataagcaaaagacataagatatattcatgtactcagtattgattaaatctgtaaagaaaaaatagattggaatgaagaaaagtatcaggtggagaaagcatgccagaaagcattcagatcactagggggtaattaactgattgggaattggagatattatattcagggacagaattgtattcagtggcagacagctactcttttttaacttttatattaggttcaggagtacatgtgcaggtttgttacataggtaaattgcgtgtcatgggggtttaatgtacacattatttcatcgcccaggtaataagtatggtgcctgataggtagtttttctgatcctctccctcctcccaccttttactcttgagtaggctccagtgtctgttgttccccactttatatccatgtgttcttgttattaactcccctttttttttttttttttgaggtggagtttcgctcttgttgcccagactggagtgcagtggcacgatctcggctcaccacaacctccgcctcccgagtttcaagcgattctcctgcctcagcctcccaagtagctgggattacaggcatgcgccaccacgcctggctaattttgtatttttagtagagacggggtttctccatgttggtcaggctggtctcgaactcccgacctcaggtgatcccgctcgcctcggcctcccaaagtactaggttacaggtataagccactgcgcccagcctaactcccacttataagtgagaacatgtgatatttggttttctgttcatgcactagtttgctaaggataacggctccagctgcatccatgttgctacaatcttatttttgtctgggttgtattccatggtgtatatgtagcatattttcttaatcagtctactgttgatggacatttatgttgattccccatctttgctactgtgaatagtgctgcaataaacatatatgtgcatgtgtctttatcgtagaacaatttatattcctttgggtatataccaaataatgaggttgctgggttgaatggtatttctgttttaacttctttgaggaatcaccacactgctttccacaatggcagaattgattaacattcccaccagcagtcaccacacctggccaatatcttatgcatacattttcagatactgatgcttctactgttattataacaattcacaggatgtatatactggatcagagtgtgtgtatacacacacacacacacacacactctgctctagtagatacatctatacatatatatatacgcatcatttcagggagatatagacatatctatacaagtatatgtgtatctacacatatacacatatatatctatacatctatacacatatatacatatgtatacatctatacacatatatacatatgtatacatctatatacatatatacatacacacacatatatacacatatatatgtaattttagtaggtgtttccacctgccttcctagaaacaatttagaattacatattttaaccagaatgtataagaataggctcttctctcaccaggaaatttttgttttgtttttgattcttttagttttgtttgtatgatcaaatacatcactttgttaacttttatttccatgattccttgtgcatttgaatatatttttgtatcactgacctattacaattccatgtgtgaattgtctgttaatatgttttgctcattaatttctatatggtagttttcttttccttcttgaattttaagagctcttggtaaataagagataacatttgtagaatgcttaccacttgcaaaatgtgattatatttcttataattcaacaaaattttgtatttcattcaaaagtaaaactgtcttacagatttatgatctttgctttttgactgttaagtacaaaggttaacctgacatcacaaaaggaattgtggagtttttttcttttcatatgctttggaatagcttaaagtatataaattattctttaagggttacgttaaattcatttgtaaagaatcctactacactcttcaacagtacacctttaataacctactaaatgttttctgaagtaatcagtctaattttccacttattcttatctcaattttagtgatttgtattgtacgagaaaatcaagttttccagaattttgcaaaattgttataaaattgcttttagtttccacttcatttcttctgtatctgctgtcatgcgtcttttctcatttatctcgtctagtttttattctaagttttctttgttatgactgggataggtttacctattttgttaatcttttcaagagctcacttttgaatggattattcttattcaattttctacgttgaatacaatttttatttttgtttctatttttacaatttcttaagatgcatacttcttttatttccatcttttaaaaatcttatggctatacagttctctctgaatacagatttcactatgcctacatcattagagtatgtatgagctatataaattttaccaagagttcatgaacattttacatttatgtgcattttaccaagagggaaacagagtatcaaagataaatgaagcttccacaaggtctgatttaaaactatgtctggatagaagatatttcattaattacatctagtgaattctccacaaaaagctttaagaggctctctctccaagttaataaacatttcacaccatgatacagacaaggattattatttattttggttgtgttttgtctcttgtacatgtcttcttcaaactaccaaggagtgtaagaaatgctaattgataaccatgaagactctagaggagggaggtatttgtcatgcctgaaagggtattgttcatggcatttatattactcttcaatgcctcacattgacggtctggtctgttttggccatgaattctcataagcttgttgctcttataatgctgtatttcttactattagctgtaagtcataacatttttctgaattcagtactatttcctcttaaataatcatcaccctgccatacagtaacttctcttttatgtttttttttctaatacacattccagaattatgtctttcaagaattatcagtctaattgctaaataactgaatggtaaaaatattaaaaccttttaaaatctgtgtgaagtgaatgattacatctgtctactaagcaaaacagaaaacattaatatgacatgtatgttaatgtacgagcctactgtgtgtatcagtgttgtgacaagcactctatggttggaaattaaatagtagggtcactgtggttacccaaagttctgctttcctgttttgcacaatgaaaacatctgataccaaaataggtgtgaaaattgatattctgtgtgaaaatgtaataacatgccttgagtttttgcagaaataagttaaactacgcagcacaattggcttttgtagttcctgtcaacaggcctaagattttactcataaagtaacatgggatgctgtctcagagttttacactgttatcttcggaagttgctttattcaaatgtaattttggaggatagaaaacctccatggtttgctttgacataatggaaacttattgtgactccagtagaatattaaaatgtgaactctttagaaacacctcaagttacaataagcagtctgtaagaattgcacatagaaaacctaatacattaaattattctttagtatggagtagtctcctgctgtctattttaaaggcataggacaagaacttaagggggtccctcttctatcgccagactagtacttacaatacataattttgtataacaatatatatttagtaattctaagattaatatataatcatttcagggagcatttacttccaggtactctacctcctaaatgactgggctatgaggaacaattctcgtcatttgcttgttcgagacaggcaaaaaacctcgctgttttcttttatcccactttccttcaggaacatggatgtaatttctaccatcgtcaatattttattcaagctaagattagatatcccatgatggtttacagtaaaaggatttatacttattatattgatatattcaagatttaagaatacttaagaaaaacttaagatgaaagtaaacctgaaatatgatggttttctgaaagattattgacaggaacaagttagtgttatttttgatttgctttacagaaagaagaatagcagactagggttcatcaaacagaaaatagtaaataagacgtcagaatgaggggcatgtaacttgaaaataatttcaataaccaagtcaaataatgaaaatggaagttcttagggcagagcagaaggagagagagaagggaaaatgatgaataaaactaagagttacattcctgtaagatatttacgtgtgtgtgtgtgtgtgtgtgtgtgtgtgtgtgtgtgtgtgtgtgtgtgatgtgtggtttgtgtatgagagagagaaaaagacaggtgacaaagttctgacaaagctttaatgaattttttcatacaattttatttttgttagatgcagagagagatggatgtttagagttttgtgtatcatttaagcatttgcggttttaacttggaagttgcagaaagttatatctcattcacaggggaaccatcatctttataatatatggtgtctgcctcttcttgcctttttagacaaccagtgacaaggacatttcagagctacaggctctaatgaaaacacgtcctgcgtcattcagccaattgaaattagactaaagcaggtcgtttctcacatttgtttcaaaggaattggttctcccagatcatttcagagtttgatatttgtcctaagaaggagtcacttttgttccctcatatgcagtgtaaaatacaagcatttttaaaattagctaagggagggggataagggtaagctaccttttcactcagtcttggtgattttaactagatatgaaatggtacaaactattataaaataatttcacaaaaagattctgaaaggaaccctgaaatatccttaaaagtttgagttgatttccttaaacagaatcttaaacaataactaaaagggaaatcccatgcattgaaaattattatgtaaatatccttcctgacactgaaacctcaagcatgtacttccaccatctatttggttctttcatttcttttcatttcatttcgttctcataaaatatatataaaccgagaagttccttccaacattctagataaacagaatttgctttttaaacatgttaaatgtcttttataagatgtctgccatcatgtagccaagctaaagacttctccatattcaagagaaacttctcaagtattcatacaatccttctaaatataatgcattttaaaaagataaaaaatacaggaaaggcaaagtagtttcattgccctgcagcatgtgcttttacaccacatttaagatttacactgtttaaaatttcaagacttatgggcataaatcatacctattttcttccattgagagatgcatgtattgaatctttttcttattaaatcataaatacgtcgatatatacaacctaaacggtgggccatattgccactgtggacctggatttccaatgacagctttttattcccttccttatctccgtatttcaagaattatttttgattcagatatagaaatttacattagataatttttgaagcacattttgacctcaactatattacaagatttaattctgggtactcactacaaagatactatctctaccttcaatgattaagttttacatatttagtcattctttaactatttttgaccactcactatatgccacgcatagaatgttaagaataaatttaaaaaatagactttcaacaaattgcttatggacaagtgaaatgttaaatttcctctatatttcagatatgtttatgatcactctgatacattgcaggagaattatttttaatggagtcatgttttcatttgtttatatactgcctctttgacaataaagaattgaggcagttaatacaagtgtctcataatcctaagaaaatatgaacatttaatggcatgaaagacattaaaacaaatttatcaaaatagaagttttgatacaggtaatctggttgaacgtattaataaaatgcaaactaaactttttgggaaagtagctcttttaactaaactcaacaaaattccttatatagaatatatattagagggcattgcctgagtaaatggacactgtcctcaatactttcacaatttagtatgaaagatatatatactttcagtatattatttaatttgaatttttgtaattacgtatcttttatctggcaatataggatgtaactttaacgacaaaaatcaacccatatagccccaactttttaagctcaagtcacgtatactaatttcaagtaaaaaaaaaaaaaaaaaagcaatagctacaataaaaatcttaaaagatacttgagtgacattataagaaatatttttaaacagtactatttatagttatataattattatcccagcagacctccatatgtgaacataataggtaactggctatctcaatttgaagttgaatatacaagaaatgtgtcaatactaatttcccttaaagcaagaggtatactaagggggatgggaagaataaacaactcacccagaaaattattttaaatgagaacatgctgcaatttaagagtagttatattaccttgcaactgaatgtgagtttaatgaatacgagattatgtttgtatatttgtatcttccataacaagtattttgaaagaagtgaacatttactattaatgcatttcgcagatgataaagtgagtcaaagtcacggaatcatttggcaaagaccctatagttgataagttacagagttaacaagatctacctcttctgcaaacttgagaattaatacatataaagtgcaaatattttacaggcctattgtgtggactgacaattttgtgtaagaaatacttgtctaacaaattaaatttggaatttgtacttaaatactagattttatgagtaataaatagaagtagtttatagtcaaatatattctgacatgctccaaaatatgtattatatggctatttaagtttctgaatacttaaaggacacataaaatactagttttaaagaacattttagaatcctctttatctaacattatatgccagcatgtgaacagtatatcatttttcagatcagtgacatctgacaaccattcaatctaattcagtgactattttcaatgatggggttaagtgaatatttgaacatagctgtcatctgaatttccaccctaggctttttaaatactcaccttggatttgtgatttaatgtatagcaatgactatttgctttgtagtatcccacattgtagatttgaagttacttggtaaaaacttaccaccttgtgatagacaattgatgagctggtacaatgaacataattattagatctacaactgtgtcagttaatattaaattatattaagtcagcgaagtcttggtaatgttcctagggtatatttcaacactataccttttgtatgaatctttataaaagggatcggaattcataaaatgtaagcaaggaaatcataagagggaagacgaggacacaagcttggagaaaggaagacagatcataatacatcttggggagcggggggtagtttaaagcaccacagttaaatctctatcaaatttgtaatttctaagttcctttaccagacaaaaaattaatcattaaactagacacaaaattattaaaagtgcaaatatctaatagagaatactcactgattagaacttagttatatccaaggaaagtttaaattacccattaaatatctttgagagaatagagttaagtgtagaactgaatttaaaatgcctaatgaaaggcactacttacaaacaaaagtgggacagggcaaagaaataatagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggttaaacgccaggacagggaaaggaaagaaactgaggaacagggttaaactgaggagctagtttagaactacagaatatgctagaactagtgatttatggcagagggacaggctaaaatggaggagaccctaaggaaaagagagaagacaaaatgaccttgacttaatgatccagaaattaccaaaaagtatcattttgaaaagacacttctaatattcctttaaaaatcagagggctaaattttgagtgatttttttaaaccagggtttcttttcataggtttatagaattaggaggctgttcatatgattttctattagcaattatcaatttcttggtgtgtggacaaacttatcactggtattcaaaaaaaaatttttttttttggagacaagtcttgctcgatcccccagactagagtgcagtggtatgatcacctctcagtgcaacctccgcctcatgggttcaagtgattctcatgcctcagcctccccagtagctggaattacaggcgccagccaccacacccgtctaatttttttttttttagtagagacggggttttgccatgttggccaggatggtctcgaactcctgacctcaggtgatctgcccgccccagcctcccaaagtgctgggattacaggtgtgagccaccacgctcggcctcaacttcattttttataataaacatatatgtatttctgtgtaaaacccgtttttggtttctatatctcatacttaatatttcccttccatttttaaactgcatacatttgtttttctccctccttgtctggatcacattcataagatattaatctatttcatattataaggaactagctgtatattttatctagtgtttcttctatttctttatctttagttcctgctttccttaaagcatttttgtaacatttttatttgaaagcttgattcaatttatctttttaatgaagatcaaaatcaaagacaaaaattcaaactctcagtacagcctgagccatttctcatgggttttcatatggaatgctttttccttcacaaatgtagttttatactcttggtttaacaaaccttaatcaaacttaatttataagtatattattagtttctactgttattaaataacatgaattttgaaagtttgtgtgtatttaatgacattttcactgcattcaaatatattgcccgtttataatttgtgtatgtggcaggaaattttttttactattttcctaagcctttaacaagtttacgacgaagagcagatatccgaagtgactctcagcgtgtctttcttttctggctctggttgtctccagaagaataggaaggagtccttagtccccaaattagccagaaaccacgtctactctctgtcatcaaatagaagtggtatggcctcaaaggtgactggcttcctgatgcatccaacaagactgggccctagccaacatcagagttctcggcatgcagattctcaagtcctcatttcgcacagaaacaaaacagaactagatacctggaatgccgattataccgttttccactcctacttcactaacccaccaaacttcttcacctcttctttgtatgtgatgactacatcacctggaatctcttaaccttggacttctggttagactaaactaaggagcggcactggcaaaacactggaggattctatggagagactaaggtatcacttctctcaacttcaccaggcaatgatttgaaactaacagcattctttagatacctaggggctcagttcacagttgtgtccagtggcgctctcccaacatgagggattttatcaaattaatagccctctccccttgactgcttaggtttagatgtagtaaaggttattaactcatgtgaatccctgcattcttcaccatagtttcttcctttaatcctccccacgtttctataaatattcccctgattacactctcttcaactttttctgtatgccacgtgtttaatatcaggacagttaatacacttgacttcacaagataccttaaaattgtatagtgaatgtatcacttggttgcctcaatgaactgaaaatgaaaatgcttttgccctatgaaagacaccatgtggatctactgagctctggccattccataggctcaggggagagcattcccaataatgacagacatacgattttctgaatgccttgttgagagttcagacttgaatttagttaatgtaactgaaatttttaaactattgctcttcttgcacatccaacttcatagggagatttattgataatgctcatattttatagaagtatctactatgctttagtgttgagatacagaaaatcactattaaacctacagttatttgtactctcaatcttttgctgttaaatatgtcataaacttgacagtggtgaattaatggctctaaaaatatatttccatcaatttttcttcatggatttagcagcatttctactgtgcgatacgttttcgttattgactgtaactttcttgaataaaatgacactctaagtttgttagtattctatcactgatttttcattttgtctgatttttcctgttttatattttttattattctttaagttctggggtacatgtgcaggtttgttacatagttatacacctgcgatagtggtttgctgtacccatagacccgtcacctacattaggtatttctcctaattctatccctcccctagccccccaccctctgacaggccatggtgtgtgacgttcccctcctaatgtccatatgttctcattgttcagctaccacttatgagtcagaacatgcggtgtttggttttctgttcttgtgttagtttgctgagaatgatggtttccagcttcatccatgtccctgcaaaggacatgaactcattctttttttatggctgcatagtattccatggtgtatatgtaccacattttcttaatccagtctatcactgatggacatttggccaacatacatacgaaaaaatgcttatcacttgtcattagaaaaatgcaaatcaaaaccacaatgagataccatttaacaacagttagaatggcaatcattaaaaagtcagcaaaagatgctggagagaatatggagaaataggaatgcttttacactgttggtgggaatgtaaattagttcaaccattgtggaagacagtgtggtgattcctcaaggatctggaactagaaataccatttgacccagcaatcctgttactgggtatatatccaaaggattataaatcattctactatgaagacacatgcacacatctgttcattgtggcactattcacaatagcaaagacttggaactattactgatttttaaaataacctgacttatgacccatttaatttctagtagtgtttttttagtcattgtcatctcatttagacctgagtccaaatgccaacaatggctcaccatgctttcttcttctcacccccaccttactacctctctgctcccctatctctgctatgtttcctttatctctaaactcactctactccacttgctgaggcctcattccaaatgctttttcaccttaaggtctttattaccgtgcctaacccaccttcctatagacaattccaaggctcactccctttctccaggtctctgctcatataggaactgaaccaaaaggtcttctcagacctcttattctatgtatctcttttttattcacttaactgttcctaagtatatatgcttcatattgcctaccatgtggctgtaatctctgacacacaaagggttgtgtttgctctgacaccaatcaatcaacttatatacctgtgaattttaaaaggaaatttggataggacttcttcaatgtgattatttatatcctgcacaggcttattgatatagaacacacccaagctcaactttagaaaaaaaatcctgcttgagcattttgatttattcttcctaataagcaaactaaagttgtacttatggatgttttccatttttgtttatacttatgacaaaatggagaattataagataatgcattttttttttttcactctgtggccaggctggagtgcagtggcacgatctccactcactgcaacctctgctcccaggttcacgtgattctcctgcctcagcctcatgagtagctgggactacagatgcacaccaccacgctcagctaatttttgtgtttttagtagagatggggtttcaccatgttggccaggatggtctcaatttcttgacatcatgatccacccgcctggaccacccaaagtgctggtattacaggcatgagccaccgcgcccagcctagatttacttttgaaaatccatgtgttattgttcagccacaggctaaggtaaaggttcctttgttccaagtttggtttctgcatgagaatgtcttgaggttttgtcctctaacgcataggccagcatcttatgcagctccccattaaagctctagctcagatgaaagcattgttaatatctgcttttgaacaactccttctcaaatttaagccattattttggggccttttccctactaaaacattaggaggttctatattttctgtaagaaatgtggccttccctgaagagattcatatgacatcatattctaattttatattcacttatattcatttaataatttcattagaaaacatggggtctatgatcagatttctatatatggcccgtggagtttcggaggttttaagttcccttcataagttcctcttttaattgaagtggaatatgcatatagaaaaatatacataagtgtacaacttgatgcgttttcttacagtaaatacacatgtgtaacagctatcaggtcaaaacatggaacagtgagcaccgcagaagattctcttatgcgttttactgacttactccttccaaaagttaaccactctcttcaattttaaacccatggaaacattttgcccgtttttgaaatttaattgaaagaaatcatagtaggtataatttgtctgatttatttcactcaaatacattttaacgacttcatcttgtatattgtgtgtagctatcatttggtcattttcattgctctgtaatatcccatcatgagaatgtatcatagtcacttccagtttgggctatcacaaatgaaactgctatgaacattctcacatatatatgtgtttttggcaaactgggaaatgtatttctgtaacttgtatgtctacaatagaattgctgggtggtaagaaatgtgcattttcacatttagtagatcatgcccaactctttaattagttgcctgaattatatttccagaagttaattgtgagatttccagttgatccatgtcctcatcaacatttggcattagtagtctagttcagtcattttggtaattttgtactggtatctcattacagctctaatttaaatttcctcaagttactgctgaggttaaacatttcttaaatatgattcttgaatttgtgaacaccttttgtgttcctgttcaatttcagtttctcattctagaaaacctaaaatttaaaaaaaaaatcaagaaaaacagaagactgggatactccatatgtaaatgtgtcagttattctctatagatttaactcaatgttaatcatacttaaaatgaatgtacatgtaaatggaaaagattacaaaacaaatacaaaaatagaaagggccaataaccaataaaatctcgaacaaagtgggagaacctagttcaccagatactaggctgtattataaaactacattactccacattacatgatatttgtgtgtgtagagagagagagaacaatgcaagagaattgaagtgcaaaaacagacccacatatgtacggacaaatttttaatgacacacttagtactgtgaagcaatgaggaagcattatttttaataaatggtgtgttaattagacttcaaataaaataaatactgagtcttaacctattcctcacaccatatgcaataatcaatttcaggtaaaacagatccaaaaacaaaatggtaaaacgataatggttctatagataataacctaatatagtatcataatggctttgggtaggccagtatttcttcaacaggtcataaaaatataaagttttaaagaataaactatatccaagtggagaacttgtttttattaatattaaccattgaagtgagtaaaaaggtaatccacagaaaaggaaaatacatttgcaactcaaaacaaagggctcatatccagaatatagcaataactcaattttgatgaagtccaagttaacttttctctttttgaaacatgctttggattcaggtatcataaatacttgcctatcccaaagtcatataaatttccttctatatgttttattgccaggatttttctggttcccttggagtaggcagatagccagaaatgagcaggcaagggagccccattgagaaaagaagtcctgaagatgctgtttcactgagtcagtgctgcctgttgacaatcagcgaaacggacaatgaatacacacactgtccacactgattatgtctagccttgtggttgggctcctctagccccaaaggggacttctcaggccctcgccagagataaccacgctagggattttccccactgacaagcatgcacacactcctccaaaaacttgccctattcttttgctcattgtaatagtgtaaacaaacaaacaaacaaaaaaacccacacacccctgggtggagattttagatgccaatgagatgtggtatgtgtgctagcatgtacaaccagagcatgtgtgcccaaaaaacctcccaaaacatacttgcaagtaagaccccccccatacaccctttcatgatttatcacgtaggagtctcaaagttccccagcactagctgctgctggctctttgttcccttgtgttcgtgtgcattcagtgtttagctcgtacttattgagaatatgtgttattcggttttctgtttctgtgttagtttacttaggataatgacctccagactcatccatgttgctgcaaaggacatgatctaattcttttctgtggctgcatagtattgtatttcatgctgtatatgtaccaaattattattatttttttttttgatatggaatctcgctctgcctcccaggctggagtgcagtggcacgatctccactcactgcaacctcagcctctgggttcaagcaattctcctacctcagcctcccgagtagctgggattacaggcatgcaccagcatactcagctaatttttgtattttttagtagagacggggtttcgccatggtggccaggctggtctcgaactcctgacctctggtgatctgccagcctcggcctcccacagtgctgggattacaggcatgagcaccgcgcccgacctgtaccgcattttctttatgcaggattgagttttacaggatatcccaaagtttgtttttttaaatgacattttcttgctggggacagtcaagctacaaataaattaaatctaataattctgtgttccgctcttttcttcactgctacattttgaaacagaatatgatattttgatatttcaaagacattttctttgtgtaactttaatattgttaacaattctcataatgtcaatgacactgatatttccaaagagtccatcggactaataaacaagaaaatcagctcatagattattctggctgcggagtgaaaaatctagttaatttcttcctaagacaaacatctctgtaaaataactttcataggttaaaggtgacaatgaccctgaattcataaaatcagccaattaattgctgcacagtttccatttccatatcttatgtaatgtcatctccctgccagataagctgagcaacatttgggggagtacatgttattattaatctatccctgcttatggttattttaagagtaagtgatcaacgtactcaatgtacttgagtttatctttgaaagagagaggtaatgtaattagggagctactaagtgcctggtgaaatgtattggtcgattagacagattttaggatgttaataagaaaggaaggctgcctccaatgccatgacacaggggaagagtcaccaagtggttcagaggagattagaattcctctgacctgcctacttggtttagctgtgactgtttacttcttctaatgcaacacacgtattttaatccagttaaatctaaaccaaaaaaacaaatctgccattcataccccaagtaaaaatagtgatgtttctgtataatttatatgcttggagacagcgtttaataagtgttggcttgatttaaacaaacatcattatcaggtttgaacacatttagtacataaatatttggtatagaaaaatccgtttgttgcacaaaacactgccgtaagaaacagagttcaccgggcacggtggctcacgcctgtaatctcagcacttcgggaggctgaggcaggtggatcacctgaggtcaggagttcgagactagccttggccaacatggtgaaaccctgtctctactaaaaatacaaaaattagctggccatagtggcatgtgcctgtaatcccagctactcgggaggctgagacaggagaatagcttaaacctggaaggcagagtttgcagtgagccgagatcacgccactgcactccagcctgggacagaagagcgagactccatctcaaaaaaaaaaaaaaagaaaagaaaagaaaagaaaagaaaaaagaaaaagaaaagcaaagtaagaaaagaaaccgagttgactgcaggactttgtccaccaaacacagcttcatgaagtaaaatctgaaaacagggagcagcctatcaggtcaggtctatgtcttttcccttccctctgtggcagcatgcatttgcttcctgaattatattagccacaatcaggcatacacgaattacaacatgtgctctcagtaagaactggtctgatttacaagagaatttgaaatactttctctgcatttggggccaaagccctcactcaaacatgaagcatgctgtgtcacagcatccagaccttgtccagggtactacttacattattgttctgcaaaacccgcagtgccttgttgacattgttcagggcatgaactcttgtggatcctttttcttttggctgagaacaaaacaaaagagtgttcactgaccagcagagagaccgacaatctactagaaatgaaaccatttataatttcactattaagcttgaatattgtaaacgaacagagcctgtgaggcattaatataatgaatctaaatactttgcgctaattgtccttggcctggtacgtttttagcataaaccaaccactctaagaatggcaacactttttctttacaaagcctattttggtatgattgtttcttcattctatagcccagttggggattactgcatgaccaccaatgacagaaacatcagcatgcataaaaacattttctagtaagatagaaaaacaattcccaaactttttagaaaaatctaaaggagatttgactctagcaaaattatataatgccaaatagggttaaaggaaaccttttctgtgaagattaccttaattgtccttgtcactgaagctctaaacctcaatcactttggttccctaattttattctcaatcccaaaagttgtatcttatcctgtaatttttaaaccaacatctgcatagttcattgtaatatacaaattaactcatttattaagttgtagagttttagaaattctaccattatgataacctgttttatttactctcattttcatttcttttaccttactacaagcccttattagctattgcccagagaaatctaacctctttcccttctccactcactcaccatttttttcatccttccttcataccatcaacaatgacgttcctgaagtaagcccactgccaatgcaaaccacttgcaaagttctcacctaaacatttgggtgattataggtaacagttaagggcaagagctacaaagctgactgcctgggttcaattgtcagctctgctgtttttgtgctgtctggcctacataaaaaatttaatctccctgtataccagttttctcatctgttaaaaatggacttaatgaaaatattagcaagaggcatacacaagttacaacatgtgctctcaataacaactgctctgatttacaagagaattcgacatactttcttctctgcatttgaggtcaaagccctcactcaaacatgaagcatgctgtctcacaggatccagaccttgtccagggcactacttattgttcatattgctcaaaccattgtacatatggtttctggcagaattcagtgtgtcgatatgcataaagcactaagattggtgcttgtcacatagttggtccaacataaatattattgacttcgtagtatgtgccaagtactttgaatgcactacctttaatccccgccttgcaaggcagttagtttcatccctattgtacagaagtgaacctcaggttaaaatatctaatatatagattaccatataactaataattggtggagccaggacccaaacttttgtctgtgtctgtagagccccagtcttgcaaatttatttccttcttctctaactaccttgtgcatgcaccaaacaaatatctatatttctgtgtcttgcatttaactcctatactttccagcaaagctcctggtctttctcaagtagttcctcaccctagaactccttatcatttgcactgcctgctgaacaacccaaattaagctaaagccatcttactctccaaggtaacttgcctgatatcctttataacacagtattgacatcttgttcctttgatttcacaaaacattaaggctaaccttatgaaccagaatctccatttttacctcttagattttcctccaagaatgtcagaatgatgttggtttacattctgatatttctcccactttccaccaaaaagaggaaaaaaataagactttagatttaaaaaaaaaaaaaaaaaaaaaaaagcaacagccagacatttggggaggctgaggcaggtggctcattgagatcaggagctcaagaccagcctggccaacatggtgaaaccccatgtctactaaaaatacaaaacttagccaggcatgatggaacatgcctgtagtctcagctacttgggaggccgaggcaggaaaattgcttgaacccaggaggcagaggttgcagtgagccaagatcatgtcgctgactccagcctgggcgacagagtaagattccatcaaaataaaaaaaaaatacatgaaagaaaaacagcaaataaccaatcttcttgtgtatatatagattgacagtatacaagtttaatggtaattataggactttaaagttttgaaaataattactcaaatcagttctctgcctagtagttagaccaaagccacatatttcctttcaattatgtaattatatagtcacaagatttagcaaaattttcctttgtatcatattcaaacattaaatgtacacatgtgcatatgtattagaaccaaacatagtctactcttttaaaaagctgcagtttctgatcctgaagtgggaacttaaaatctgcccctattagagtctccttggggagtatttcttattttatgattgtaaggcaagtaccttccttttaaccctggggatgtcctgagccaataatccaaatgcagatgcttctgagtagaatactaaaatttctgttctatagtatacatgcctcccattaggagtagaagatatatctctacagaaactattagaattcaagacaaggcatagcgaattggagttctgggatcgggagcatttgttagaggtgattctgctttatgagaaaggcaaaatcctcagaccagggctgacagatctgtgattaggacaaacaatggtgaatggattctgttagtagcagtatctgaaattatgtaatctacactgccatgtgtaaatgtttggtgatttttccctaccactagcttaccttatactggccaatctcatggatattttgtttgatatttttttctttaatgctattactaattaggttcattttgtcttagcgtctatgtatgtatatgcataaatgcaaatcatgtggattttttaattttgccgaaattagtggttttttctttatatcaaatgggtagtgtgccaacatcataagtttagagaaaggcttatctcatatctgagtataaacacccaaatcatgcttatgaattacgaaaggatctgaaattcattatcttaaacattatgtatgaaatttgttaaccctgactaaattgctttgggtgatagatggattgactcagtcagggaaatgaccagaggattgcaacacaggagaagtgatcacgcagatacctggaagtgaagagacaacagcctcctaacagagggccaggacaagatgagtaagccataatctttgaaagatttttcacgaacatttggaagacactgggacttctgtattcggtaacaaagtaggactgacttcagaatacaggagaaacgagatacacagacacactgatttctgtacatatgctacgtatccatatatatgtaaattgttcacagtcataggagatgaattacacacaaatctatctctaactagtgaaattaagaccaagtttacatgatgacctcaaattggcgcccagcaaacagttcagctataaggtattaaatctgattttcccccttgactaaagttattatttcaatatgtcatcaagttgttcttctattagtacaagttcagacttcttgaaaaaaatggatccgttttagtattaatctcacatagctgaagataaaaaatgaaagcataggtatgtctcttctgtataggacttcagaatttaattgaggagggatgtcagtcatacatacactaaaaacaagacaaaaatgggccttctgtggaatttgggagggaaaaattagcaaaggtaatttgggaaaagctttactgaggtgaaatcaaggtttctggcagacagttggggtagacagaagtacaaaaagaaatacaggcaagtaaaataatacaggcaaaaacccagagatatctgacaatatataccgagaaaagagtggcttagcgttaagtgttacaggaggcaggctggggtagataggatttttgctaactgactttgaacgacagcttcagtttgtataatatgacaaaatctgtgtgtgtctgtgtgtgtatgtgcatgtgctggggagttgtaatgaagggcaaagataagagacgaaggctatgatttagcagaatttgataggtagaacagttatttatgactatagactgggggcttaaactctactttttagaatagcaatctaagacgattatttcagtcaggggatttcaatttgagttctttccccccccagtgtaagaccttgatcaacatgacttcactgatctgtaatcatgtatatcaatcatgtatcttcacaggaatgctctgaagttagacaagataatagttcaagaggaagtgatattttcatcacatatgctatcacgtattacactataatgcctgtaccttattttgctatcccacatgtataaactcatacaggttccttgtaaaataacttcaaaaatacacaaaagtacaaagataatttctcaagtcattatgtataaaagccttcattaagatatttgataagatagataccaagtagtaaaactgaataatatctattaatataaattgtattactgaaatttttactttttctgcaggcggtagagtatgccaaatgaaaatcatacgaggttgctttactaaggaataggtattgctgtttcaatcagtacctagtcattctactagatgtcataaaactatgttgtcagtttctggtctgaaattctactaagtttaaagttaactttcttaaaaataagtcacataccagtttttgccctgtcaggccttcgaggaggtctaggaggcgcctcccatcctgtaggtcactgaagaggttctcaatatgctgcttcccaaactgaaattaaaaaaaatacactcaatttaacaaagcacacttccaatgatacattttcacgattatccccttttgaaaactaaagctatatttaaggataattagtgtgcataattaatctgccgaagatgacggatgaaaaaaggaaagttcaaatgacaaaaaaaatttaaaaattttatcataggtcaagtctatttgaattagtttgaatagcaagagtaagagatttataccctaaatgatctaattaattcactgaaatgaatatagattctatgaaggagagaaaaaatacaggcatgatcaaggcagttacgggtaaagggaaaagtaaatacacaaagaagcaaaagaccacaatctacctgggtgggtacataaagtttaaccattcttggaatataccagtcagagtggttcgacatccttatcactcaaaacatgcttgctgtgcatacacattttgcatgctatgacctattctcatactggataactcaaattttaggaatatcgggtttaattaggtttgaaacaaccctgtgagagcttttcatctattttactcagttctttgctcaggaattatactaaggaaaaataatagtcaataaataatatttaacatttttaacgtaaatactcatgagacacactattaaatgagtggatttcataaccgttgtggcatttctgagattagcagtaacatacttaacctctaagtatctcatgtaagatgagtatgtggctctttgtcatgaaactagaatggggtaaagccaaaattatggctcagatctgtctaattctgggttcttgttctttcaatcttatgttgcttccttgtccttttataacctactatttgattatctttctaacatttgtctttcttttgtcatacttcaccaaatcgttttctgcttaaaaccctacaatcccctcatgaggtaattcccagctttttcatcacctatctggaaatccctaatttaatcagtcaaagacatattgagcatgaataaacctgagctaggtactgaatcatatgctagtacatcagacataggcccagaccctatagaacttagagtccagcaaagaaaatattcctaaaaggtactattacatagaagcattagaaaggactaaagaacatgtaacagtgggagctctcacaagccttgggatcaacaaatactttccaaaaaacgtcaggtgatgggtctaacattagcctttgggtgactgtgctctttacatacactccttggatcacatataaactttgaatttcacacaagtcaagaaaatccctggtttccaggcaaaagacatcccttaaacttccacgattaaaaacataggatttagactattcctacaaccaggtagccatgtcaatgacaagacctgtaaatgcccgggtacttcaagcagggaacaatgatacctgcggcaaccaaccagtccctgtgtgcccagctttgtgaatccagccacatatatacttagacaaaaattatgagttattcttttgaaattctactcaaatagatccattttcaaattccatgggaaaaagaacataacacaaaaccctaacatgctagaatttttaaagaatagctttactaggagggaggcagaacaagacggtcaaatacatggaaccttccagcaatcatctttcccgctaccgctgctatagaaacaccaaactgaacagatagccacacaagcaagcacctacataaaaaccaaaaatcaagtgagcaatcacagtacttgattttaatatcatatcaaggaaagaggcactgaagatggtaggaaagacagttacgaattgccaacaccacccctcccccatcccctggcagaggccatgtctcatgtagacgatctgtgtgcttgcaggagggagggcgcaggattgtgaaacgttgcattggaacccagtgctgccctgtcacagtgggaagcaacacagggcagaattcatcaagcgcacatagagggcacatttagaccagccctatccagggaggtatcacccatctcagcagttagaagctgagttccagctagtctcaccagtgtgagctcaagcactttggggtcctaaataaacttcaaagggagtctaggctacaaaaactgcaattcctgggcaagtcttggtgtcgtgctggactcgaagtcaggggacttggtgggcacacaacccagtaagacaccagtgcttgtaccaccccatcctctaacccctaacagtgcagctgacagctttgagagagactgcttcttccacttgaggagaggatagggacagtaaagatgacattgtcttgcaacttggacacaagctcaaccacagtaggataaggcatcaggcagagtcctgagaccccccattccaggccctggctcctgagtgacattcttaaatacacccagggccagaagggaacttgctaccttgaagagaagaatccagtcctggtagaattcgtcacctgctgactaaagagtccctgggtcctgaataagcagcagtagtagccaggcagtattcaccaagtcttgggtaagactcagagccatgctgtctttgggtgtggcccaatgcattcccaagtgtggtggccatggggatatactccttgtgcttttggaaaggagaggcaatagagtggactttgtcttgcagcttgggtactagctcaaccacagtcaggtagaccatcaagcaagctcctgggttctctgattgcaggccttggctcctggatggcatttctggactcacctggggcctgaggagaacccactgcacagaacggagagacccaggcctcgcagcgtttactcctagttaactaaaaagctcttgggccttgagtgaacatcagtggtagccaggcagtactcaccatgagcctgaggcagtggtagccatggggaaaaattcctctgcttatgaaatgggaaaggaagaatgggacaaactttgtattgtggcttgggtgccagctctgccacaatagaagagagcaccagatagattcataaagatgcaacttcaggccttggctcctagatggcaagcatcaaaagtcaaggataaagacaggatcctaaaagcagcaagagaaaagatacattccaaaaagcttaacaacaactagtaacaggcttctcagcagaaaacttacaggctaagacatgtcatgccatatttaaagtgctgaaggaaaagaccctttatgctaggatagtgcatccagtgaaaatctccttccaacaagaaagataaagaccttccaagacagaagctgtgggatttcatcaacaccagacctgttctacaagaaatgctaaagagaatttatcaactggaaagaagaggaccttaactagccagaaaaaccatctgaaggcacaaaactcagtaagtacagacaaacacaaactattgtaatactgtaattgtgatgtatgaactactcatatcttgaataagaagagtaaaaaaaggaagctttcagttaacaaataactctaataactttaagacatagacagtataatgagatataaacaaacaacaaaaagattaaaagagacgaagtttgagtttttaattagttttctctttgctttcttgtttatgcaaccagtgttgtctgtttgaaataatgggttatagtgtttgtaaacctcatggtagcctcaaataagaagatatactaagattcacaaaatttaaaaagcaagaaataaaagcatgccactagagaaaaatcgccttcactaaaaaggaagacaggatggaagagaaagccacaaaacaaccagaaaacaaaatggtaggaataagttcttaataataaaactgaacataaatgaaataaactctccaatcaaaacacagtgacagaaaaaaaaaaaaaaaaacaaacaacaacaacaacaacaaacaccaagactcaatctgttgcctacaagaaacacgcttcacctacaaagccagacttaaaattaagggatgtaaaaagatattccatgtcgatagcaaccaaaaaagaacaggagtagctattcttacatcaaacaaaatatatttcaagacaaactgtaagaagagacaaagatcaacatataataaaggaatcatttcagcaataagatataccaattgtaaatatatacgtaccgaacaccggagcacccagatatataaagcaacattattagacctaaagagagctggaaacctcaataccccactttcagccttggacgtcatcaggcaaaaagtcaactaggaaacattgaacttaatctgtactacagactaaatgtacctaataaatatttacagaacatttcaaccaacagctgcagagtgtacattcctctcatcaccacatggaggattctcaaggatgggccatatgttaggccacaaaacaagccttaaattcaaaaaattgaaatataaagtatcttatctgaccacagttgaatgaactgagaaatcagtaatgaggaattttgaaaattatacaaaacacaagggaattaatctatattctcttgaatgatcagtgggtcaatgaagaaattcataaggaagttataaaatttcttgaaacaaaactgtaaacacagcatactaaaacttgtgggctacagataaatcagtactagcaaagtttacagcaataagcacttgtatcaaaaaaaaaaaaaaaagagaaacaatacatcttaaagaactagaatagcaaaccaaactcaaaattagattgtgtcatgaagacatgcaaaacccgaacagaccaacaacaagtaatgagatcaaagatgtaaaaagtctcccagtgaagaaaagcccgagacctgatggcttcactgctgaatgttaccaaacattgaaacacctaatactcaaactattgtgaaaaagaggaggaggaagtacttctgaactcattctgtgaggccaatattagcctgacacgaaaaccagacagatatccagaaaacaaaactgcaggctattatctctgacaaatactgatacaaaaatcctcaacaaaatactagcaaaccaaattcaacacaacattaaaaaggtcattcgttataaccaagtggtatttgtcctagggatgccaagatgggtcaccatatgcaaaaaatcaatgtgatagatcgtatgaacagaatgaaggacaaaaaccatatcatttcaatagatgctgaaaaagcatttgataaaaattcaacatgccttcatgataaaaactctcaaaactgggtatagaagcagcataccttaacacagtaaaagccacatatgagaaacccacagctaatttcatactgaatggggaaaaactacaagacttttctctaagatctgtaacaaggatgcccactttcactactgttgtttaacatattactacaagtcctagctagatcaaagaaagaaacaaagggcatccagattgaaaaggaagaatcaaatgatccttgtttacaaaactaggaatcccattacctgacttcaaattatactacagagctatactaaccaaaaatgcatgctaatggcataaaaacagacacatagaccaatggaacagaatagagcccagacacaactccacagacctaaagtaaactcatttttaacaaaggtgccaagaacatacactgaagaaaagaccatcttttcaataaatggtgctgagaaaactggatatggatatgcaaaagaatgaaattagacccttatctctcgccatatacaaaagtatcaatctaagtggaacaaagacttaaatctaaggcctcaaactatgaaactactacaagaaatcattgggataaaatctccaagacactggtctaggcaaatatttcttgagcaataccctaccaagcacaagcaatcaaagcaaacatgcacaaatgagacatcaagttaaaaagcttctacacagcaaggaatacaatcaacaaagtgaagacacaacacacagagtaggagagaatactggccaactacccacctgacaaggaataaccaaaatctataaggggctcaaacaactccatagaaaaaaatatatataatcatctgattgaaagaagggcaaaaatttgaatagagatttctcaagagatgacacaaatgtcaaagaggaatatgaaaaggttgtcactatcattgatcagagaaatgtaaatcaaaactacaatgaggtatcatctcaccccagttaaaatggcttatatccaacagacaggcaacatcaatgctgatgcggctgtgtggaaaagggaaccttggtacatcgttgttggggatgtaaagtagtagaaccactgtgaagaactgtttgaggttcttcaaaaaaactgaaaacagaactaccatataatccagcaatcctactgccgggtatatacccaaaagaaaggaaatcagtttgtcaaagaaatatctgcaccctcatgtttattgcaaccctattcacaatagccaagatttggaagcaatccaagtatccattaacaaatgaatggataaagaaaatgtggtacatatatacgtagtggagtactactcagtcataaaaaaaaatgagacgctgtcatttgcaacaacgtggatggaactggaatacattgtattaagtgaaataagccaggcacaaaaacaaactttgcatgggctcactcatatgcagtaactaaaaattaaagcaattgaactcatggagacagagagtagaatgatgtttaccagagtgtagtatgggtagttggggacaggaggagtgggaatgtttagtgggtacaaaaatctagttagaatgagtaagatctatttggcaacacaagagggtgattacagtcaacaatttactgtacatttaagaatttgggccaggcacggtggctcacgcctgtaatcccaacactttgggaggccgaggcaggcggatcatgaggtcaggagatcgagaccatcctggctaacacagtgaaaccccgtctctactaaaaatacaaaaaattaggtgggcttggtggcgggcacctgcagtcccagctacttgggaggctgaggcaggagaacggcgtgaacccgggaggcggagcttgcaatgagcccagatagcatcactgcactccaccctgggtgacagagcaagactgcgtctcaaaaaaaaaaaaaaatttgaagtggaatgtttgtggcacaaagaaaggatacattcttgaggtgacagatacttcacttaccctgatatgattatgcttcgcatgcctgtatcaatatatctatttaccccctaaatatactatgtatccataaatttaatctaaaacaaagcaactttactatacataatatacacataaatcttaaaacagtgccattttaatgaaactttaaggaaagctctctagtaataagaaaataaatttacactttctaatagtgctgccaagaacttcatatctaacctggaataatttggtattttgagtgtaataatttgtttttcaaattgaatgaaggtatacaatgccattaaaatgatgtgtttttttccctcctttggccaggagcaaaatttcacacttatctgagcaaagcatgacttttaaactcatcaaaaaataatcttatgcactgcaatgtgtccattgttgaagaaaatatagttaactgttaactgacagagatacttgtttttatgaaaagaaaaaatccagggtagaaagttgaagtctgtcagaccaagaagtatgtgcgtgataaactgctgtttattcaaaaagaggagcagagactgggaaaggtgagagaagtcttggagtacagaataaaacatgaatcccaaagccatcaggatcatatagcatccaagacacaaggactacgtttgggtttggagacaaagtctaggcaaaggtcaaaaacgcagacagaatcttgctttgtgggccaaacttaaatacatagaccaaggtcttttataagtcttcttttaaaactggaggtaaccaaaatggagagggagtaaaggattataggtcaggtaggggattccatgtacacctagctggggcaccgagagagagaaagcagtgaggtgatagagaaacagttcctgctatcgtattattttcgaaactcacagagtcaatgatatattaaagtatcacaattgaaatccaatttctattagtcatattcaccatattctctaatagagtgcttctcagaatattctaccagagcatccttccaggaaatgaaattgaaggaatttaccctggagtctggcagtataaattacacagtgcctgcaggttttaaatttctttgaaagcatatactttatgctaaaaattcctagagattttgccttcttcttttaatatatgcttgtttcaacgtaaaactatttatttatcatttattttttgagacagagtctcgctctgttgccaggctggagtgcagtggcgcaatcttggctcactgcaacctccgcctcccaggttcaagtgattctcctgcctcagcctcccaagtagctgggactacaggcatgtgtcatcacgtccagctcagttttgtatttttagtagagacggggtttcactatgttggtcaggcttgtctccatctcttgaccttgtgatccgcctccctcagcttcccaaagtactgggattacaggcatgagccatcacacctggacttatgtaaaagtaattttaagtacttttgagtaaaaatctcccccacccccgttcccacggtctgatgtggttttttttttagtgaaatgtgctacatttagcctgtaactttatagacctttcggtgctcagttttattctccctgtagtatgaataccccaggtaaaatctaacatactatttctcttggatggttctaattttcctgcctgcaacttactctatagaattatagatactatagcaaaagtaacccaagtttcagaagcagaaatagctaacttctgaactcaggtctctcactcactcactagctgtgttatcttgggcaagtgacagcctttctgaggcacaatttattcactattagaatggggctcaaattattactccagagcactcccgtgaggttcaactgcaacacataggaacgttatacagatttggcaaatcgtatgcactcaataaatatagattgatttttatgtttcattttaacactatttgtctgcatctctttctttgaccaaattctaggtgtaaaaacgtttaactcggccaggtgcagtggctcacacctgtaatcctagcactttgggacgctgaggcaggtggctcacttaaggtcaggagttcgagaccagcctggccaacatggtcaaaccatgtctctactaaaaatacaagaattagctgggcgtggtggcacacacctgtgatcccaactactcgagaggctgaggcaggagaatcgctagaactaggaaggtggaggttgcagtgagccgagatcgtgccactgcactccggcctttgtgacgaagcaagatctcacacacacacacacacacacacacacacacacacacacacacacacacaagttaaagtcttttcgataatataaaaatattatattagaaagtgcagaatacatgtaaaatgttttctattagtttggcatccctgtgggagtgcaagtcaataggggaaggcattattccctatacaattactaaaactggtgaatgcagatggtacagaggatgcacttagaaacttgctttttcctcccttttcttgttcttttgactatttttaagtattcttttgttgttctcccctttcatcttcaacatacaccatgtctttgttgcaggtggcattttatatcctaagaacaatattttttctttaaaattcaacctttaatggcttccttttcaagtgtatgagaactattttgtgaagcacacaaaacatgaattcctccttgggccaggcgaccctgtagctctctgtcttcagttcattttatgactaagatttcccttatcaagtgaactgagtggatatctgatattactcagtttaatgtatctgcatatatattgtctttgttaacccaaaccacaacacgaaaggacctaaaaacgagacagtattccttccaaatcctttttagtatgaaataaagaaatacggaagcacaaacagtgttcaaaaagaaacacagataggtaggttgacaagtggcataaataaagtgaaccaaatcaaagtggaacaaatcaaagtaaaaaaatttgagaaaggaaatgcatttgtgaaggtgtttaagtggtttctgattcttcagagttgtattggtcttttaacctgaaaatccaaagggatcaatacgtttcagtagaaagtaaagaacacagggataatttagcatgaccttctgattacaaaaaggacaagccatggacataactgtcgctaagaaagtcaagatacttctgcaattacaaatccctagacattggaaacaccaaaaatatcgcaaataccacaaagaattgcaaaactggggattcaaaacttactgaagaacgctgctgaccagctcccagaaaaataaggcaacccattttcatgtaaataggaagctttccgagttgattttttttttgttttcttaaatatgagttggaaaaggtattgtataataaagcagtattctgttgcggaataatatacatagaggaaagtacacgtcttaagtgtacagctcaatgaattgtcacaaaccgaacatatttatattaccagcatcgagatttaagaaacagaatatgatcaacaccctagcagcttcctcacaccccctatgtggaagctcccctcaagaatggccactatgacgacttgtggcatcataggttagttttctcttgaaaggagtcacctaaagatagaaaaatgctggttttgtattttgagttagaatactagtgactgaaatacattagatttatgcagagggaatttagaaaaaagtcacactgataaaatatgctttggaaaacacgggggaatggtatgatgccatgaataagaatgttgactgtacacccagaatgccttgggttcaactcccagctctgcagtgtgatcttgggcaagtaacttctccgtgccttactcttttcatctatagaaagagcatgtatcattacctatgttgtggtgatattgcaaagatttaagtgaacttagtatggcactttgtaagatatattctgtaagtgttagctatcacacgtttattccaaactttctaagccaaataatccatatcgtctataactttccttgtaatgttggcctcaaagtaacagaagggaccaacttcaaaatatgagaattaaaagggttaataaatgtaagatgtctggtatggtacctagcatagaaaatgctcaataaaaacattaaataaattacattccctcctgttaaatgttatcacctggaggtggagaatgacactctcctttgaaatttatatggccatagcaggactttggtaatctgagaagagtttaataagggactgtttataaaaatgagggaaggtataatgaaaccactggaactagtaatagagaagtgtcactactactcttagactcctaagaatgaaaagaaggagagtggtttctagttactacatagagagagaactgagaagagaagattatctgacaggagctttgatattgggtgatggaatttctttcctctctccctctcttaccaaggctctcattggccaaatccaactagtagccagagggcaaaggagcctgttgatgtagtccacagacatcagcctcccaaggaagacaaaagtggagagtagggccaaagaaataagccaaagacattcaccaccctagacatggaagcaaatttcctttgagccaaggagatcaatgccagggatgtccatatcagaaaataaatgaaggcctacgtgttacttcccatgcctcatatttctatctctggtgatgtcattgtaaggaatcatatgtatcactggaacaccgtcgtcttctttaatagtgatatcaaaatactggaatgttttgtggaccttagcagataaaatcagtaggtatttattcattattccttagcgtcaaatacttgtagagacttctctctaccaaaaaaagcacgaaaatctggctatgaagatcatcaagaaaaagccaagttattccttgcagctagcaagtgttcaagagcaaagctacaaaatacaagtttttataatctctccagatataaaatgttatttggcattttataaagcatcttaactagaacccaatatgtatgttactctattaagtacactagaaatgattcaaacagatgtgcattcgaactttaaataggaaaccacaccatcgttaatggaaatcaagttgttatatgtaagtgggatgttatgaacccagaagtatgcttaacaaaaagtcagcatgattcattgtctgatcaggtctatccttaacatgttttgtaataaaactaacttctaaagctaggtctcaattgttttatctttaagttaggtcagtactcattcattttaccaggtattctaaaggaaatattaataaaattatggtaaatgctttatcttatatttttatgtattaatgtaattcacaaagttattttaaaatttgtggaatgattacaatccatgattatactaattacaccacctttaaatatcccctataaaattgaacattctgaaagttaaacccagttttttgttgttgttgagactctgtcaccttggctggagtgtagtggcgtgatcttggctcactgcaacctccgcctcccaggttcaagcgattctcctgcctccgcgtccctagtagctgggattacaggcgcgagccactacgcttggctaatttttttatatttttagtagagacggggtttcaccttgttagccaggctggtctcgacctcctgacctcgtgatccacctgcctcagcctcccaaagtgctgagatttacaggcatgagccactgcaccaggcctaaatccagtttttcttttgattcacatagatacatgatttgcatttgagatagccagtgatggaaatgaaggctaattacaatctatcccaatggttgcttttctgacagaaacggtatggtacaaggttggcaagatgaagcactttgtttcaaagcatgcaaataacactgattcttcaaaaaagaaatctataggctaggcgcagtggctcatgcctgtaaccccagtactttgggaggccgagaagggcagatcacttgaagccaggagtttgagaccagcctggccaacgtggcgaaactccacctttactaaaaatacaaaagttagctgggcatggtggcacgcgcctgaagtcccagctacttgggaggctaaggtgggagagaatctgggaggcagaggttgcagtgagccaagattgcaccactgcactccagcctgggtggcagagtgagactccgtctcaaaaaaaaaaaaaaaagattgtgtttatacacacacacacacacacacacacacacacacacacaaatacacacatataccatgacataatggaatggctcactagacaaacatctatgagtactcagttccagggaaattgcagagaagaaaagtgatatttaggcttcagatctagtagaggaaacattatggacaaagggcatccaaagatgactttaattaatgaatgtaaaacgtatttattaccattcttataatttctcaattaccctacggtgcagttgtgtatggacaatataggtgacaagacacagcttcttcctaattattcccatcctccacctactgggaagtcatccttggtttattcattctttcttcttccatgcctgtaagggtctgtctacaggaagttccaaatcaaagaaattggaaacacagaaaagataaatgtcacataggatacaatatttaaagaagatcttctgtcaaaagtcacagaggataaaatatttaaaggagaacgtctgtcactgctatgctttatttccttttagtggtccaactttatgcaatttccaattctgaagtcaaatattgtcaaatattacaatttttatatgactctacctcatgtatcagaaagatgcgagttacacacatcgactggtttatgtcagcgctacttctgtgtactttttgtgggttgttttaatgttcacagtcacccccattttacaactgatgaaacagacacaatataagtaacttgaataaggtcacacagcaagtaagtgctagatactaatttggacttaggcagtgtatctacagatctctacaccattctttactttgcaactgctgtttaagctgggcttgactatcatcacattcaggggcaagggttaggtgagttttacttgagcctttacgtcatcttttctacaaagatagtttaatatatcttttctttcttctatcatttccaaaaggtcagatacagttatatagcctgccaataaaattgctcctaattgtaggtcccatttgtaatggaaagatagtaacagtgataattctacatatatacattaggaaaattcttcaaagtcccaaattcctattgttatatcatttgacatcgggggtttcattaactcctcaggactccagtgtgctcagcagactcaattactaaatactattttagagcacactgcaaattgttcgaatgtataattcactctaatgtatttgaaaaatgtggctttttatattaactaaagaagaaatatcattcaacaaaaacttaaggctatataaatcaaaatataagaaatataatccttgaagttgataaggattaaatgaggtagtagtaaacagaagaaaaagtttaactagggcatttagtgtagccatttcttaagatccactgaaaagtgccagttccttacttgaaagtcttccatgtgagattcggtgtagttgtaagttaaataatatagtatctggaagcaaataggcctttatttattacagttctataatttaaattttgccagttgtgtgaacactgataaattacatagcacttggcttattttccttatgtgtcagacgagggggatagtcattcaactaaatgtaaccagtattatgcatcatactgtcctaagaaaaatgggaagataaaagataaaaacatactgccactgttttcacagcttttgtaatagcctaggaaggaaatatacatttaagcgaatataattatagcatggtgttataatcctattaatagtgatttttttgtcgtaagtatggtgctggcacaaataaaagatatcttcactggagagaacaacagagtgaaaatccctgaatagaatatacaaggttgaacaggttatcaacaggtagaagtgtaaagggaagataaagtcaagcagaggaaacttcacatgctaaggatcagatgaaatagacgcactgttcaaggaactataagccacttcttggaacgtaagtggacggatggaacatgagactagagaggtacaagacaccccatccgagtgtaccgacttgattaaccacccaaagctgcttaggcaaatgtctgcttgtcttttcttttcaccctttcaaacataactaattttgagaagctcttaccatgttttgcattttttaattcatattttgactgacactttaacatagtattgtttaggaaaaaccaatattggcactgtttaccaattatttgcatgcaaaaatatttggcaaggaagccatactgtccaggagcaactgctgtaaatggtaagttaactacaaaattgggcctagtatttcatcctttcctgaatccataccctttgcaatgtagcattgctgttcttctcatgaaaagttggtatctatttccctgcttcttaaatctgggttggcatttgactcattttgaccaacagagtgcaattgaagtgctggcatttcctctcccaaatgtagacctcaaaagggcttgaacacttttgctctcttgttcatgcctctgcatttaccgtaagagcacatcagagctagacagcaggaggatgagacaagtggaaccgagtcaagttgccctagttgtcccagatgaagttttcccagactagcagacagccagacatttcgcagagctgagctgagatcagcaaagccccttagccaacccccagctaactagagacacacgagtaatcctagcagtaaggtgaagaacttcctggctaacatatgtatttgaaatagtatgttggttgttttaacctactgagtttcaaggtggcttattacacagcaatagctaatatgtgtacatacatatgaatatttgtttctacacagaagatgtctgaaaaattaagccacattataaagatatttataaaatatttttaaaagagccctaggagtttttatgagaaatatcaagctagaaattattttactgctgaaattgaatatgggcaaaagtcagtttctagagatctgactcatgtgctattagaaaagaacacagtcattatattccatgcagttcctccaatgcaatcttgcaaaaaagaattaacgaagcaatagttttgtcagtttcatagaaattttttaaatacagtgtcaaccttaatatatacatacacacacttttttttgggggggggtgggggggtggggggggggggacagagtttcactctttcgcccagcctgcagcgcagtggtgtggtctcagctcactgcaacctccgtctcccagtgtcaagcgattctcctgcctcagccttccaagtagctgggattacaggcgcatgccaccacgcccagctgatttttgtatttttttagtagaaacagggtttcaccacattggccaggccagtctcaaactcctgacctcgtgatccgcccacctcggcctcccaaagtgctgggattataggcctgaaccaccgtacccggccaactttcaaatatttctaaagctacctttcgtaagacttagtgtttaactcttctgttgtagccactgtattgtaaatgcaactaaggttgtattccttgcccaatatgttcatttgacgttcaattggagaagttaaaaaaaaaaaaaagttgactttatttttctcccatttgctagatttttactgtcactttagataaaaagtgtgtttatcttgttttcttcattataagctataatttccagtggtttattcagacatttccaaaacaaaaatagtaaatcaaaaatagttccctgtgaactaaaactgtcacctttagttagtgtttctagaaaaatgcattttaaaataaagttgaataagagccaaaggaaagtagagttgacaatttttttcttacaaagctcaaagaaaaaatttaaaattgccctatgagaaaatcttaataggtacctgacatttcaataggaaaaattagttataactgcttaaatagaagtttttaccaagagctttattacataactacaaaaggtacctaattcagtgattcatctttatcagcaaacatttgctaattgtaaacaatcctgtacaaaatatttttatttcaaagaggtagcaactttccaaaaatattgaaccaaaaggaaattgaaatgaccttggtttaaaatatcattatcagcttgaaaagtggaaactatcaaatagttaaccaactttttaaaagattggtgctcactcacctggctgaatgacctacctctttgaaccttaaatttaaataatggctcggtccacattaaccttctcttgattttagactgtaatatccaatatgggaatttaagcaaaaacttaaagttacatcaaaaatggaaaaatatggagagaggccaagatgaccaactaggaacagctgcagtcagaggctcccactgagaagaaccaaaaccgtgagtgaatcctgcaccagcaacagaggtgtccaggttctctcactgggactgactaggcagttggcatgagagcgcaaggaaaagcagggtggtgccatggcccacctgggagccaaacgcgacaagggaagctcccactcccagccaagggaggtagtgagtgattgtcctaccctgcctgggaaatctttctttttccacagatctgtgcaacccgcagatcaggagatcccacttgcgagcccatgccaacagggccttgggtctcaaaacacagctgtgcagattctcgcaggccactcggatggagacgactccttaagactgctcagtttccgggggcgggggcggccatcatcactgcagctgcctgttacagcaaatgactgagctctcccggggaggggcggcatctaagagaactgccacctaagagaactgagctgctgtggggaggggcagcagccatcacggtggctaccggcttactgagaggactgagctcctgtagggagggcagcagccatcactgcagctccagtccaccatttttccccttcaggtttgagggagactggacagtttgaacccaggaggaattccctgcagtacagcacaccagctatggcaaataatggccagattgcctcattaggccggactctgacccatccctcctcactgggcagggcctgcttgcaggaattccagtaactccagccaggggtttagggaaagaactccgattcccctggacctgagcccctagggggaggggtggccatggtctccgcagatcagcggacttagtctttaccctgctggctctaaagaatccgggaagcccagacaagtgggattcccccaggacagcaaaccccctcgaccaaggggcagccagagtgcttccttaagtgggtcctggatcccgtgcaccctgactgggtgagacccacccccaacagcagtcgctagacaccttatacaggaaggttcctgctggcatctggtcagtgaccctcagggacagagatactagaggaaggagcaggcagccatctttgctgttctgcagcctccttaggtgacatttccaagtgcagaagggacccaggtgaatggggtctggagcgaacccccaacaaactgcagcagccctatagaagagggacctgttaaaaaagcaaacagaaagcaacaacaacagcatcaacaaaaaaaatcccaattaaaaccccatccaaaggtcagcagcctccaagattgaaactagacaaactcatgaagatgagaatcaaaaaacaaaaacactgaaaactcaaaaagccagagtgcctcttctcctgcaagtgattgcaactcctctccagcaagggcacagaagtggacagaggctgagacggctgaattgacagaagtaggcttcagaagatgagtaataacgaactttactgagctaaaggagcatggtctaacccaatgcaaagaagttaagagccatgataaaacattacaggagctgttaacaagaattatcagtctagagagtaacataaatgacccaagggagctgaaaaaacacaagaacttcacaatgctaccgcaagtatcaataaccaaatagaccaagcagaagaatgaatttcagagcttgaagattatcttgctgaaataacaccagcagacaagattagagaaaaaagaatgcaaaggaatgaatagacgcagaaaagtcttgataaaattcaacatcctttcatgttaaaaaccttcagtagattaggtattgatggaacatgtctctaaataagagctatttatgacaaacctacagccaatatcatactagatgggcaaaaactggctgtaggttttggtatgacaaacccttgaaaaccagcacaagacaaggatgccctctcttaccattcctattcaacactgtattggaatttctggccagggcaatcaggcaagagaaagaaatcaaggataaataggaagagaggaagtcaaactgtctcttctgtgtatctagaaaactccatcgtctcaccccaaaatctccttaagctggcaagcaaattcagcaaagtctcaggatacaaaaatcaatgtgtaaaaatcacaagcattcctacaacaatagacagagagccaaatcatgtatgaactcccatttacaatggctacaaagagaataaagtaagtaggaatacagctaacaggctaagtgcaccacctcttcaaggagagctacaaaccactgctcaaggaactaagaggacacaaacaaatggaagaacattccatgctcatggatagaatcaatactgtgaaaatggccatactgtataatttatagattcaatgctattcccatttatctaccattgacattattcacagaattagaaaaaaagaaaactgttttaaaattcatacagaaccaaaaaggagcccatatagccaagacaatcctaagcaaaaataacaaagctagaagcctaatgctacctgacttcagactatactacccaaaacatcatggtactggtagaaaaacagacacatagaccaatggaacagaaccaacatcttggaaataagatcacacatctaatacccaaccaactgatgtttgacaaacctgacaaaaacaagcaatggggaaaggattccctatttaataaatggtgctgggaagactggctagccatattcagaaaactgaaactggacaccttccttacaccttatacaaaaattaactcaagatggattaaagacttaaacacaaaacccactaactataaaaaccctgtaagaaaatctaagcaataccattcaggatatatgcacaggcaaagattttgatttcctgacaaaaacatcagtcaattgcaacaaaactaaaaattaacaactgagatagaactaaaaggcttctgtacagcaaaaaaaaaaaaaaaaaaaaaaaaaaaaaaccacaaaacccatcatcagaatgaacaggcaaactacagaatttttgcaatctatttaccattaacaaaacattcttcccctgcatccttgccgtaagcttcgacctcagccttggatagacccaccctcctccaacctgcaatcttttcccgtgttttttttctcttaatcttggtctatttttcctctctgcttcaccaacagttcatctccctattctttcttcagtgtcttctgaaaccctagaataatttgaatggttgtctttatgccctcagtctcagctattccataacaaactctccttacttagaatttgatcttcatgtttgtttacctgcaatggtaaacaggcttaaggcttgtctccttcccccgccctccccatacttaagatcaagtgggaggtttctattttaacatattaactgatgccttccctcattcttggaagctatatatgtgtacttcctcaagcgtgctactataaaaatacaaggaaagagacatcaaggatcaaataatgtgtttctcagtaattccctggaatctattgataagattagagccctgcattgaaaaatccttagtatattgagcaccaatgacattatctatctcgtaaataagagctgggaagattgtgtaagatacagtttgactcattccaaaggaaatgtttttcaacttccagctgttcaactggaacaagaacagtattgtaatggattatggtaagacacagtcgttgttatgagcttctgacaaagtactgtatcattccactcccactctgagactaagtttcagaaaccctatataggtttagaagaattccagagttaagatgtaccttgcttgctagaatatggtttgggaggtcaaatccactcagtcaccccctccctccccatcataacactagcacagtaggttaaggcatgaatgagtcaggtgtcaaagcaggcgagactgaaagtatgcttctgggcactccaggcatgattaaattggtatgaaaaggacacgagagaggacatgatatccaagggcttgactggatcccagtcatcgttggtggtgacatggggatagagaccaacagactgaatgattacttgtatcagcagaagacttcaagagaggatgactataggcttgtcatccccgatttctggatgtgacttaagtccctttaaatttaaaggttgctaatgccatcatgaccaactaccattgaacattttaactgatgctctgacctcacagctttttgacctgctaagctgcaatgactttgatcaatttgcgtccatgttcatggccagttcatgctttctcacctacctcgaaccatcctaccccatggatcacacacagtgaattgctcacttaaaccacagtatactgttcttgaaacttctgtcccctttttaaaattcaagtattatctacaatgtgacagatatcacatgaggttagattgaataatgatttagtttctgcatttctggagcttactgtctcaagaagatgaacaacaaataagagatgacaacattttacatgctaaggtagaaataaagtcaactgaaaaagaattttaaggctaagctataggaagccctttctgaagagatacaattcaaggtatgatcttaaaaaggagattttataaaaagggaagaattacagatagcaggcacaagatgcacaaagggaagtaggggaagtggatgctaaatgaagttagtgggcaaagaaggataaggggtaagccacagtagagatgttaaactaaatgtaatagagatgcttttacaggctttgggtaggagagatatgatctagtttgtgttttataaagatctctatggctcctgtcagaagacatcaaggagggcaagagaagcaatggaagactccagtgcctcatgcattcattttaaaactcttagtggtggctaatcttatttaaactaatcttagtggtggctaccacctcaccatcaggtaaatctccttctctcactcactgttgatcataattgctttatcaattgttagtcctgattttacccagcctccgattcttttagttccctttttgattgctatgcaattcctgaagtggtcatataacccaggcctgtaggtcctcaggacacatggcatttcatcaccgaccctttcctgctttgctcaaatgtcaggggaataagcccccctcctccttttaaaagctgacccctaaatatgtgcttttgagataattggctaccaacatctctaggatttaattctcttccctcctcgttcacatacacacaggcatctagatatggcaggcagtaggcattagagtgagagagcagacattgaagctacactcaggcctgtttctcagactttagtatatattagaaccacctggatgagcccgttatgacatgcattgcctgttaattctgatccaagtgtacagaggactacaattttgaggaaataattctaggctcagctttaccactgattaagtagccatgagtacatcaaggcacatttctgagcattcatttcttatatgaaaatgaagtaggttacagtggttattctctaaggatactctcagcactcacagtcccctattctgtgtctagaatctaaataaggctaggaaaaaatgcaaacataaaatgataacattgtaaaagctaagaatagttactaaaaattagccaaaaccctttgcttctccaaagtcgaataaaaatcaagtaatgacatgttatgtataattgccatcaaataaaaggaaaggaattttatcttagcctaagctaagggtaagattttcaatctgaagtccacagggacaagaccaagaacaggaacctaacaagtcctttgcaatgatctgaataatgaaacatcccttagatcagagtttctcaacatttgtttgcacatgaaacctctgaagatgttagtcaagtgcagactcgtgtgaggtctaggatagcgcctgaaaatgtacatttctaacaaaacctcaactggtgctcctagattgcagaccataatttgagttgcaaggccttaagtctatccctcacagcagctgtcataccaaattttcactttaacaacaatgaaaaccttaacagaaagtgtttggcactttcacaaaagaacagataagcttttcatgtctttttcttaaatctgtgttcacccattgttgagggtagaacattgcgacaagttcatttttacagagagccaaagtaagattccccaaggaagttttctgatattctctattgatacaaagattgagcttagaaaatgtagaagaatgaacggtcagcatgagccttgaactctggctaccatcaattgtttcctgccaagatgcatctcttttctttcctaaaaactgccagttttctctctcgcctggcttgtttgtgcaaggatcttctttcttctgcccttctcagctagagtcactgacacactctcctcctgtgagatatgcatcactcaataccatggtaggaggaggaaatttacagcagttatgatggactagaaatggccacaaaattatttgacacttctttcatcaagaggcagcatctaattctccccttaaagctcggatttgtcttagcaacttgtctgccaagtagaatgcaacgaatatgatgttataggtcttccaagattagatcattattagtaacttttagcctctttatgggtttcttagaatactcactctgggagccctaagatgccatgcataaaaactgactaccctgaaaccaccatgctgtagaagacatctacaagtcctctggttgacagtccctgctgaactgagcctttcagccattctcacaatggcattaagcattaagtgaatctgtcttgaaccctccagaccagcacatccactagctgaattctgccaagtgatgtcaactgacaccacacagagtagaaaaatcaataagctgaacacggctgaattcctgattcacaaaatcagataaaaagataaaagagatgttattttaagccactgtacttggggtgttttgttacatagtaatagaaaaccagaagagtatcctaagctccctctggaatggaggctctgccttgaatcacagccctctcgatcgagaccttgatacatgtccctcttcatcgactcttgaactctttctggttccctgatttactattgcctatgtttctatttaacagattacaccctgtctcccagcactcagtctcttcttagttacacctgaatttccccagtgcctgtcctgcctagtctgtattttctccttttcctccagcctacactgctataaccttaggatactttcaacctgctgtgagaaactctatgcaaagtgtttccatgataattttctgctcttttcccttctgtagggagatatgttttggctatctctaccagtttatctacttctaatttcactttaatccagtgccaggcccggttgtaagcaccgaagaataaatgaatgactattggataagtgaattagtgagtgaatgaataaataaatacatcaatgcatttataggttatggtctactactccactgaaattgttactttaaaattagtcaaagcaaccagaaaaccgaatggtcttttctcagaccccaagtaaatttcaattcaatcactgcctttggtcaatgtagtcacctccttaaaaactgtttttcttgctgcttctgtgaccagacactttacagtttcctgtgacttctcctaacacttctttgctggcttctctatatctgcacgtatttaaatgtgaattctccaagacttggttttgggttcctttttaactgtgtataatatccttttgccgtatcatctgcccccatggcttaaactccatattgattacccccaaaccattttctttagttgtggtatcttgcctatgatactttctcactgctacacctatcaaacacacactgatttccctcctcagatccagacatattttccggagattattggatatcccatcaatacatcaaagacaatatatcccaaatacaaatcacttccccatcatagttttgcttatttctatttctaaccatatccaatgataccaccatcctctcaatttttcagccctaagacataagttattttcacctcattcttgccacatcctttaattacatcaatactgatatccctgttgtctctagatacaaaatgtcagttataataaactctaaaatggtttcttcacctataatcctcaaatcttgacagttatccaatttagtctatgtagtacaactagttattttcctaaaccgttcttgtaagtactccaaccacagttgccccctagtgctttcttattctgtagattgtatttttgtgttctagccttccactccaccaacacctttcttcaaggctctgtttgaatgaattcttgattcccatgtgccttgccattcctttataaccaactccaaaaaaagtccctcctgatcttgcggtctctcggtcatttgttcatgtcccttaatgacatattgtcattatctgacttgaagttgttgtaggtttcctcactactttatgagcccctggctgaaagatatttttttttaatcccctactaaaactagcattgtctattgcacatagtgaatgttccgtgtttcttaaatttggagctgttgaacagtttcagttttcagctacattcactttttgactgagttgtaccataggtgacactaatctgtgccaaatggggcacatttaaactacttacactattactttaatgttttcattgaacgcaggaatctttgtagcctctaggtacatttaaactttaagataaaaattatattctgtcaaatgatttataatcaataccattgccaattaaaatcaaataatagacacagaagtgcctcaaagcttcaactaagatagacacaaaggggtgccagtggataacagtgttatttcataatcacagcttcccttttccctctagcaattattctgatgcagaatcagtcttaagaggtttctgcagctagatgtaaacaaagaagtatcattacaaaactcacttgactacacttctgacaccctggttggggaaatgtatatggattgatatgtctgactgacaagaactcaaaatttaaatgatcccttgtccaagagccctgtggttatcatttagaattcatctgcacaagtcattaagtatactctttggaaaactattttgttccggaaaaatgtaaagtcaagaagcaggaatgctaacatttgaaaaaagcttctttaataatgctataattctgaactttttgtttatattagaaaatattttttcttttaactctagctatagtacaattagagatgtttcaaaattattcaggtaagtgcttaattgggtccacgtaatcttctgaaagttagccctttagaggttatagccaaaaaatcgtgttttatccagatccactaagattccattaacacttctgcgtgcccacctccttggcttttgtggtctttgcttctcaaaacttctgtatctacatctctttagatgactgtcttcaggctagtaaagctgctttgccaacaaaaacagagatccggaagtgccttggtgtttatgtcaccttagggtagtcttaaggcaatgactggtgactactggaatacaaaagcccagctccttctgtatcaagttgcaacaagctgaagcatagtttaggcccaggttttcctgcagaaccagactgaggctggcactttgcctgcgattgctccttgcatgatttcttccccattcctattctacttctcttgctcacctacttgccatccctgagaacatttccttaattaaactactttcatgcaaattctcctctccacatgggctttaccaaaacccaacctgaaacataagcattcctctaattacagtaataaaggcatcagatttctatttgaaaatactaggaatgggccgggcgcggtggctcacgcctgtaatcccagcactttgggaggccgaggagggcggatcacgaggtcaggagatcaagaccatcctggctaacacggtgaaaccccatctctctctaataaaaagacaaaaattagccgggtgtagtggcgggcgcctgtagtcccagctactcgggaggctaaggcaggagaatggcatgaacctgggaggcggagcttgcagtgagccgagattgctccactgcaccccagcctgggcgacagagtgagactacgtctcaaaaataataaaaataatatggtgttaaactgattaatctttaacttcgacagaatgttagagttcaaacctgtagctctatggaggttttgattaccattataatccattaacacaatatgttactaagatagcatttcagagcacagtatgattttcttgtagctatactacaaaactacaatactacagtatctgtattactttagaaaatctctaaaaaagttgtgaattatactgccaatggtttgattagatagaatcttactgatttttaaataatatcaaatttttccatctctaatcatgaaaagagtggtgaggtagggcaggataaatcgtaatattggggccaggtgcaatggctcatgcctgtaagcccaacactttgggaggctgaggcaggtggatcacgaggtcaggagttcgagaccagcctgaccgagatggagaaaccccatctctattaaaaacacaaaaattagccgggcacagtggcaggtacctgtaatcccagctactggggaggctgaggcaggagagttgcttgaacccgggaggcggaggttgcattgagttgagacagcaccactgcactctagcctaggcgacagaccaagactacgtctcaaaaaaaaaacaaaaaacaaaaaacaaacaaaaaaaaaacaactaatatttgtatattaatataaactcctgaatccctcatgacataatatccatgtgtatcaagcctttttattcctgcatctgttaccgttattctccctatgcctctcacagccagaaggaaaactgaaagtctactatcttccttttggtaaaaatttgaaaagaagggcattcaggtagagatggcatttattaatgccagtgactgcggcagactgttcttgggccgctgggaagcctgtggtgataaacagcattggaggaagaaagagtcaccatttacatatggcacatgactctcatcacagcttgtgttgcttattcaccagtttgactttgcccttgccaaaaggttagacaacctctgctatgccctcctcatcctactggcaaattaccactttgttcccattttatgaaattattgaataaagatcaccattaatatttgtcttttttaataccagttattgacaagtgatcgtcgttcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcataatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccacacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccattacggtcatgtcaaactacttactggttcctgaactcaattggtttgtgacttcatactcctcagcatttttttttttttttaatcagccaataggctgaaagctccaacagggccaaaaaaaaaaaagcctttttcagcttagtcttcttagcaactaactgattgtctgcctataaaagatgtttaatcaatgtttggaagagatggacttgaatggcctgttgtactcttgttggcatgaaaatccctttaagtttctagtctatagttgatatcaatttcaaccccaatacaaccctagccaagcaaaattcgtctcttcttccttctgctcccatgcatacccccgtggtaggacatactatatagtcttgtaattgcttttgattgcttttgaaatacctatttttcccatttatatgccatctcttaactacagtgccaggtatatggcagaatctcaaaactgagttaaaaagactaagatttctgggctaggcgcagtggctcacgcctgtaatcccagcactttagacggccgaggtgggaagaccacctgaggtcgggagttcgagaccagcctgaccaacatggagaaacctcatctctactacaaatacaaaattagccaggtgtggtgacgcatgcctgtaatcccagctactcaggaggctgaggcaggagaatcgcttgaacccagaaggcggaggttgcggtgagccgatattgcgccatcgcactccagcctgggcaacgacagcaaaactccatctcaaaaaaaagaaaaagaaaaaaactaagatttctttcaaacctgtaatctgatgatgattgtatgcaattctttttaaaaagctaaaaatcttagattgagttatttatgaatacaaacaggtatgaagcagaaaccacgaaggcagctggcaaaaaataccagagtaagtacagctaggaactgtagatgccagtgtcagtctacatctttgaactgtatgaaagagcctattggacactaagtatttatcaaattctttctctttgaagctagttctaaaaacaatagaaacaaaaggaattttagctaacttgctttaccttggctacagaatattttaaatctaacattccaaatagttcttaaagtattctgaactggtttctttctgtgaagacaattatgatttctgagtctatgaataattgtatacttacgcaatgttaggacagtattatctgtaaaatgatttgatgttcaatatttctactattaatcttggaaaagtaaaaaatatcttctatcagaggaaatctaacactctcaaaaataagttaaatatgatacaatggcagttctacaacatccagatattcaatagtaggcagcaattattacttgccataattcacatctttgaaaaattcaagagggcaaactaattttgccaatgtgaaggagctgtaagaaaaattatgctttaatggaaatataagatgtttttgttgccttaagtattgctttttaatccttgaaattcagtcaaatacttaataattattttccatatatcttattagacatattagcactcatgctggttagagattttatcttcctcagagccataccaacacacccttctaaaccctactttgcaacgctgaggcaaagactctgcaaaccgtacttctggctttactgactgactctcagaatctaaaggtagggagcaatagagggagactgcaagcctggaggagggacaaaggatttactcattcacactagcttcccatgcacttactgtccttattagcagttccctagacgtgcttcttcatgcctgcagcagcactttttagtaacaagctattcaatttagcttgtgttttgtttttcaaaagcttagagaatcagcttcatcgcccctgctgcagaaataccagcaccacctggctggcagaggtccgggcctcagtcccattgggcccttcctgctatcccagagagggtagcaccagccacgtagcagccccctactcagacctgagctcagctttgtagagtccttcctcaagggttctaagtgttagtaattctaaccttttgtcttcccagccctaggagcggtagctactttgtgcacttgctacctcttctctttgtcaatttttcaatacctagatcccaattcctcttgttacattattttctgctacagtcactcaagtggtttctgtctgttaactgaccctggctgacacatcatcccaaacccaaaacttgtcactatcaaaatggaaatacattaagtgttgggtctgtgtttaatgggtaaggatgatttctcattcttccaaagaccacatattatattccactattgttttctactacttttataaaataatgactaaatatagatatacttcagtacaaggatatttgatcttctggacagccgtatccatatgtgcattctttctgtagatggaactcagttgtattagagtcaaaaacttttttaaaaattctaaccatggacagttgaatcaaatctagccctgtagttatttttcaaagtcaacatgaatagtaaaaaataaaatattgtcaaaaatccacctggaaaattgctataccatccatactatacacataatatggattagattttaaatactgcgtagtcacctcctgcacaccaaagtttaggaagacattgagctaaactcaaagagcaaaaagccagagtgtatgcagctttcttaacatgcaattcttcctgcctctaaggtaagccctagattgttttctttacctgcagggctttctgcagtatgtcttaatagtaaagataatccagcacagcatttgtaatatgcttgtgatcaagaatggatggaaacaggatggtatagtcctaacttaagcatgtaaattaattgcatctcataatgtcagccaatccacactcttagtcatacagattaaagaaccaaaaggaacccaaggaaatcagaaagggtaattctgcttagaaagttgctcttacatttcatatacatggttgaagtttgacctcaaaaaaagaaaaatcaatttcaggcactgaacggcaattgtgtaacttatttattaaatttataatacaatgaaatctgagttttctattactctcatttcttatttggacactggtaattgcttctttcttatgcatttttaaagtataaatcctgatactagctggcactaccccaatattttttccctttaactttggaattttccttttaaaaaattgtcattctagagttaacatgctaccagcttttcacaaattaaatttgttgttagaaaatggcttccatggccaggcgcggtggctcacgcctgtaatccccgcactttgggaggccgagccaggtggatcacgaggtcaggagttcgagaccaccctggctaacacggtgaaaccccgtctctactaaaaatacaaaaaattagccgggcatggtggcgggcacctgtagtcccagctacttgggaggctgaggcaggagaatggcgtgaacccgggaggcagaggttgcagtgagccgagatcatgccactgcactccagcctgggtgacagagcaagactctgtttcaaaaaaaaaaaaaaaaaaaaaaaaaaaagaaaatgacttccattttatccaaaatttaggctcttaaaaatgtatcccttttcatgatattcttaatattaatgttctgtagatgttctatagaggcacttgaaataaactcaacatatctaataaagacagaaatggaaaggtaagtacataggttttctggttttgatgtactctatcccttgcctgttttttcttgaccaatacatacaatgttacttaaacatgccatcctcaatattcccaatgtcccctatactaagactagtcttgaccccagactgaaggaacttaaagttcccactaggaaatagtagggtgacataggaaagtaactcatccgaaaagattttctttagtggttcaacctatacaaacataccacccagggaatacagcaggcccagtgataattctagacatattcaacataatgatttccaatcaggtaggcaggaaatgaggaaaagctgttgagtgacagttaagtggcagggaaatatataattaaccaatcaatttaacaacaattagttaaaagcggtaccaacagctacttttattgagcccttactatgggccaggcactttatatacatcatctaacttaatattcaccaaaaaattcaggaaggcaatatttgtcaatattttgaattttattttttaaaccaatggagagtctgacagaaaatttgaacaagttgcaccaagtcctaaaactaacagatgttgctggaattggaaccaggaccatgtgctacagtaacttgctcaagtttctactaagctatgctccactctacgcaactctaagtttcatcaatacactggaactcatttcatatactcattccccttagtctattaccatgaaatacactaggttcaaacttgcaataagaaatcattaagggactcatcaccttacaattccaagtacagacaagtgtggaaatgatcctaccaaacaaggagaagtgtatcactgtcgcctttacatcttctcaggatgttaactttatctccagcttaatgacaagcacaaattcttgtagttcttaaatttcaggctgttctttagttttatagtacatatttaactgtatttatacccatgcctgagaaaatgctgtgtcttataaagtcatataatgctgaaggtcaaggaatatgctcttgccagatttgtagggatcctagcctagcaccactcacacgtaatcatttattaaaaattatttttctgatcatgatgctaatctgttcagagtcataggcccataaagacaatatttcctatgggttaagatgtgctaatctcattaactgaacaaaccagaatgaatttaatcacagcagtcaagggaagctaccgcatcattccaagacaaattagagatattgtacccctgtggtgttatctttgatttcgattagaggtttcaggctgcttcctatggctagattcaaaatattaagcctactaaagagaatgaaaggtaagtttatgactttgcatcttggaactgcactactgataactgcaaagcctaaggctttgaagagaaatgacaaaaaaaagtcaatcatattttcataaatattaagcttcccaattgtatataaatataaagaaaacatgcacattactttttaaaatgattcaggagataaactactggtataagtgatcatgttatcactaaatctcatgaaaaatatattaagctataacgattagcctgcttttaaaaatgtgtatgaaagtcagttattaaaagctagatgatgttgttaaataaagaaacttacaatgtgttgaaatttccctattggagaattataaaacaaataaaatagtgtttttctgatgcatcacataaaatgtagaagcgaaatttgagggtttagaatatttcaataaaatattaaatgcctgggcagtctccgtaattgtttcccttgagggggaaaaaaaaaaaaaaaaaaaaaacctttcctttcaggtagtaggcacacagttttactcaccccttgtctctccaaatctagactccaaatatatattagtcacaataaaactcacattcttattctgcttgactaatttgtagtcaagctgaatacaattcagtggaaactgaatatgaaataaattcatctaataaaaaggtaccaatgactgtataacaacatatgtagataaaagtgtatcatatataaaacattcaatcccacatggcagctttcctggaatataaaatcattttatcattatgggtattagctcatgaagtcagtattattttaaaaacatgctaagaatgttagcttcaaaatttaatatctcaaaagcaggattttggttataccaagtggtttataaaatagagatatttatccatacacagttttatgtgacaatttaggtgtccttatagcttcttggtgggcagtgtaaactggtaaaaaataataataataataattttgctaagtatttttgcgatacatataaagaccctttaaaaaatgttaatatcctggctgggcacggtggctcaagcctgtaatcccagcactttgggaggccgaggtgggaagattacaaggtcaggagatcgagaccatcctggcgaacacggtgaaaccccgtctctactaaaaatacaaaaagttagccaggcgtggtggcaggcgcctgtggtcccagctactcgggaggctgaggcaggagaatggcgtgaacccaggaggcgaagcttgcagtgagccgagatcgcgccactgcactccagcctgggcgacagagcaagactccgtctcaaaaaaaaaggtaatatcctttgacctaataatttcatgcgctggaagctgtctaaaaggaaacaaaatggtctactgggttatttagaacaacaaaaataaaaaactaaatgcctaactttagaataagtggtcattatgtgaacatttaaagtgtgtctataataacctaaaatcacttatgtgatagtaaaaaagggtgaaaagtcataaatatagcacgatcacatctaaataaatagcagaaaaccctcatttcgggtaaaaaggaacccaatgaaatatgccaaaatgataacaatgactttaagtgagaatatggttaattttgtttccttttacttcttccattcaattgggaatattaataattggacccttacagctgggcatggtggctcacacctgtaatcccagcactttgggaggctgaggcgggcagatcacgaggtcaggagatcgagaccatcctggctaacacggtgaaaccccgtctctactaaaaatacaaaaaattagccgggcgtgctgacaggagcctgtagtcccagctacttgggaggctgaggcaggagaatggtgtgaacccgggaggcggagcttgcagtgagccgagatcccatcactgcactccagcctggatgacagagcaagaatccatctcaaaaaaaataaataaataaaaagaaaattggacccttatctgttatatacaagaatcgactcaaaatggattaaagacttacaggtaaaacctgaaactaaaactactagaagaaaacatggactatgagaggtggctcatgcctgtaatcccagtactttgggaggttgaggcgggcagatcatgaggtcaggggtttgagaccagcctggcaaacatggcgaaaccccgtctctactaaaaatacaaaaattagccggtcgttgtggtgagcgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatccaaaaatatataagaaaccttaaactcaatagcaatacaacaacccaattaaatatgggcaaaggacctcaacagactttttttttgaaataaaaaagcttttaaaatatgacaaagtaaaatcacagtggcaactgtgattaaggaactgaatttttattttttattttttttaagttctgggatacatgtgcagaacgtgcaggcttcttacataggtatacatgtgccatggtggtttgctgcatctatcaacccgtcatctaggttttaagtcctgtgtgcattaggtatttgtcctaatgctctccctccccttgctccctacgcccccacccccacaggctccggtctgtcatgttcccctccccgtgtccatgtctcaacgagcatgtcttaagggaaacaaatggacaacaggtatatgacaaaatgcttatcattagtcaggtaactgcaaattaaaacaatatgctatcaccccacacctgtcagaatggctattctcaaaaagacaaaggataactagtgttggtgagaatatggaaaagagggaaaccttggacccttaatgggaacataaataggtacagccattatggaaaacagcaggaagttcttcaaaaaaaaataaaaatagaactaccatacaatccagcaatctcactactgggtacatacctaaggaaatgacatcagtatatcaagtagatatctgcacacccgtgtttattgtggcagtattcacattagacaagatatggaatcaacctaagtaaccatcaacagatgaacggattcaaaaatgtggaatatacacacaatggaacactattcaactttaataagaaaatcctgtaattgggaacaatgtggttgaacctggaggattttggagttttcaaattctcaagtccaggcacggaaaattataatttttttttttggaaaaaaatgtgaaatatagacactattttctccgtctctgagcctagatactattttcctggactggatggagaatgtaaagtagaaacaagagtgtgttcctgagaggaggggatggtgaaagaaccgccaccacaacagagaaggttgggggtatccaggtgcagaagtaattgggtcccattccagagtccagcccaggaatgcaacaagactccaaagttatgtcagacccaggcaagaatcgtgagcatgtgtcttagcaaatggacatgagctagccacccagtacccaggcacttcagcaggatatagggtacagtagaataatttcccacatgcctccagcaaacacagtgctcaatgggtttttggaggatgaagaatgacaagggaaccaccatgtttcttgaccgtacagagatatgaaagggcctacaacttgaggccaaggaacaaggtccctatgggatgaattgtacatgaaatcaggtaagccacacccgccttcaaatcctggcactgtatcagtgtcaggactctgagctaagccatcatatcccctgtgacctgcccttatacatccagatggcctgaagcaactgaagatccacaaaagagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgctcgcaaaacatcgctcctaactccaccgcctatcccaaaacctgtaagaactaatgataatcccaccacccttggctgactcctttttcagactcagcccacctgcacccaggtgaaataaacagccttgttgctcacacaaagcctgtttggtggtctcttcactcggaggggcgtgacaatcaggtcccctccagaaatttaagacaaaaccccagagaaagggggggcatctcagtcctaaattggctgagatgaaatatgcaggatctaccggaaagtaggctttatatataaattaagttcagattcaagaaaaggcagttattgagattcactgccactgcatgtagatccttatgtggggatttctaagaatcattgtccagcacctaaactgcaaagcaaaccggtaataaatcagacaacaattaagagccaagtcatcttgagacaagagctcaggactcagagaagcagcctgcaaatgtgaaatggacattcagaagtcagtgagtttctgaactagcagtgcccggttacgaagctgttgaagagccttgtggactgctttatatgttctgggtagttccataggtcctcgcagaaagagaaaataaacctttcgttgaaattaaccttagacctagattcttaaaggactcaaacttttcgcggggaaggaaaggccagtctattgacaggagctgtagatattaaggcctgtggggggtgggggagggggactcattatctgggaaaagccacacccttaatccatcataaacagtgatgcctggggcacagttgagactacaccttggaggaagaatctaggtttttcctatccaactccaaaagaaacacatttcaatggcaactgctgaaaaacaagcaaacaaaaagtaccagcacctttttgtttctttggtaagaaggcgaaacatcccagattgtctaaaaaaaagaaattcgggaaatcagaacgttttatcatgatctggggttatgttgtccagtaagatagccactagttatatgtggctactgaacatttgaaatgggactagcataactgaggaagccaaattttcattttgctttatttttgcttcaattttatttatattgaaaacaaacagtttttaatattcttccattaaccataacttcattggtttgggagaacaagtttactttaacccatgaaaatatggcaactgaattcagatgtgctgtaaatgtaaaatatcctccaaccttaatgatttagtacattcttttcactaacgtaaaatgtctcattaagtcttttttgattacatgttgaaatattttagctaaataaaacattaatgtcacctgtttattttcactttttaaagtggctactcaaaaagtttaaattacatatatagcttatatttcttttggacagcactggcctggagtacagttcaaaaatagggcaaaaattcagagttacttcttccacatctgagttttgcgaacatttattcctgctacatacacaccagtctgtgtatctacacataatgaaaaacagacttttctcaatcccctcatatacagagggcaggtgagtgagccagtgagagaagactgagaggtaagtggatcatataaattaagatggcctaacaacattagaatcattaggatttaatcctataacttatgacaacagtccaagatgcaaagtgatttttaaaagtgatctaaattaaattttctagttttccttttctttccctttaataggtttcatgaaaatcaagaattataaggcggggaggtaaggctggagaagacaatctaataaagcgatgtaggacaaatgagaaaaatcaggcttccttattctactccaacactttccaactgtcatgaccttcatggtctgtctgtacctcaattctctgatcagtaaaatttggatgaaatatgctggactctgttgagacaaaatgaaaacataaggagagtctatcatctgtaaatcactacattatgtacccattagtattttattgttagcaaagattaatagaaaactgacaactccaaggctggatggcatgaagccctacacctagtagttgctgccatagtctgatttgaggttcctcaaatcattcttccccagcctaatcattttttctcttcagacctggaatcctgccatcctctcgcgtcatagtttgggggttactgcctgcatatgccaatgaacagtatagccacgtgacacagaaatgaaggccacagaaccataattcatcagttattcaatgtgttagctgacaacttggaaatcatagagcactcaactccaagttacttcctgaaaagcagagaaatgcttcctcagtgaggccacagaactcacagctttacattttacctacaatttgcacatgatccacatgatctggcctcggctttccctcaaccccttacaactgttacagtttcatagccttctgtcagtcactagacaaaactcagacacttccttccagtactggcaacattactgcacattcttcttttaggttttcagccctggctacacattagcatcacccgaggagcttttaaatctgtaccattgtgtgtttctgatgccccccacgccatgttgttttgtttgttttcgttttttgttttttgtttctttgagacagagttctactctttttgcccaggctggagcgcaacggtgcgatctcggctcactgcaacctctgcctcctgggttcaagcgattgtcatgcctcggcctcccaaatagctgggattacaggcacctgccaccacacccggctaatttttttttgtatttgtagtagagacggggtttcaccatgttggccaggatggtcttgatctcttagacctcgtgatccacccgcctcagcctcccgaagtgctgggattacaggcgtgagccacccggcctctaatgccccctttctttcataacattacacaccaagtattatttggcaaacttctcatcccctatactgtattacttattgacattgtttcccagctcaggcctacacgcttggcacattctgtctctctggccacaatgatcgtgtaagcaaggctgaaaaccaacttaaaggaatgggaagagttacaaacttaagtctcccacacatgatgcaggatgatgactttatcagatattttcatgattttatgatatttatcagacattttctcctgggaagtttatgttagagtaaaaatcatgtatcattagggagtagaggtaatgctaaaagcaaggactgagagtagttaattcatgagaatgaatgatggaatcccatgacgtgatagatcagctgctacactatggtctcaatagttcaattattcataaaattacactgatcgtagttttctaatgtgacatttttgttttgattattcggttggtcagacaactgagtaaccaaatggtttcgcctacttatttggttattcagttgttcagtttcttgacctttttaccccatgcttccttaacataagctgaatttatctctgttcaatgtaacacaaaagcccgtatttagagccagattataccagtttccagctgtgtcctcttaaacatattactcattctctcatgtcttccatttctttccttaaaaaatgagaataccacctatctcctatatatgtttgcaaacatgtttacaagatatatgtgaattaccttgcacagttagcatctctcaggatgtgaaagtgaccgtcttcctcctcagtaatttactctttgtcttatcaaagccattaaaacccctcagaggtgattaaatttgctgtgataaacagtggggttattaagcaaagtagtaaactatgaacacacctaagttttttcttaaatattgtagtggagctggaaatttttttttttaggtatttcttccatatccacaaaaaagcagcaagcccactgaaactcatctgtttgtgctactaaataatcccctacttttcctactgtaggttgatttattggtccccactttctcattcctacttaataggatggcatatctagcctatggtgggaaatgtgatagcctttggtcaacggggtgttaagaaaacatgacaggagcagagccttgagatgggctggcatgtttgggcttgctatctagtgacaacctatgaaaacatgcactgggtggccggtgccattccagtgtgtgcctctggacgtgacacatcaaagaaatccaaaccaaacctgccgctgaaagccaagcctagcaactaccagcctgatgcagaaccaaatctagatcaacttaggtcagccaaaccccgcatgaccatgagaattaatgctatttaaaaccattaagttggaggtaatgattattacttgatattattgttttgagagctgaccaatacatctgcccaaataaacgcgtttgttcacatcatgatgttgtactgaacccctataaccctcaatagcgaaggcatcaggttcaagagactgaggaagaaacccatagccagcaaacgaggcattgggttttattagaggtttacatacaggggagggaattcagtagtggtgggctggacaggagaagtgccttacctgtagaaacgatccagtggtggcagactggacaagatagcctcgcagcacagtggtagtgatggcggcggtgggatgagcgggcaaaccaacgctgcttgcgggcagcatgcagtttatatagcatttttacttaaccctctgcccttaatgacgttcacctggcaaccttcatccaacccaaaactcggggcctcaatccgctgtatgtatggcccgtgttccacgggatgcacttggggctcagatgttcctcatagacaaggaagggctctcttgctgggctactcccagattccgtagctcggaaaacacattcaggtgtgtctgcagtacagggtcattctaagggtatgcgcacattattgcaatcaggtgcatttaccatatacttgattacctatcttactggttatgttgttgttttgtgtgtacgtgtgtgtatgcatgggtgtttttacagagtcagatgtcaaccgcagggacaatacaagtgtcttactcatttcagcctgctgtaacaagataccatagactgggcagcttaaacaacagaaatttattttctcacagttctggaggctttaagtccgaggtcagtgttccagcgtgttcaagttctggagagggctctcctcctgatatgtaaacaacaaccttctcctgtgtcctcacatggcaaagcaagagcaagctctctggtgttttctttacacgggccaccggatcagagccccacctgcatgtgcttatcttaccctaattaattcccaaaggttccatctccaaatatcgtcccattgggggttagggcttcagcatatgaatttggggcaaacacgaatagtcagtccataacaacaagtgaaggactacagaatctattttatacagtaatattttcttttatgagctatatgaaagtgacaaagcaagtggtttagtattgtaataccatgacaaagattaagaactgaactgagcaaatactttatacttctggttcagttcatcataactgaattacccaaaaatataaaaggagagctgtagttgttctagaaaaatcttccttcgtgtaggagtgggtttgcgggttactgtgctaatccacacctggagttttgggcgtcaaggttgataagggtcaagggtttgggttttggctctggcttgtggaagatcgttttctgagagcattcttgggcaccagctggtcagacactcccattccaatgggacatagttttcaacagagaggaataatccaggtgtatataaggcaatacaagaaaccttgaggcttccaggccttagcaagaagaattggagtggaagtttaaaagcagaactggaacattttctaattgagggtggtagagagaattctgatatttatatattcggctgaggttgagagctttcaaggatgctgagctggctgctggcttggaatgaacgtgtgtgtgtgtgtgtgtgtgtgtgtgtgtgtagtgtagtgtaaataagcaacattgctagtcttgtaatcttataattgttcataagagaaaatacagtctagaggaagagatcatctagtttactgggaactagtaatgcttatcttgccgaggtttaaatgaatgatcacggctgtaatgacttataagaaaaattaaatctaagagcacagcctctgagcagaaactgtatacagaggtttatgtacacagctgtgcgatgaaaagaattagatgtgctgtgccctgatgcttttgcaataaagggttcaaaaatctgtggagaacaccctactccttagtacaacccagagcagtctgctgtagcctgcttaattggtatgctatgatcaaatccctcttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatcttctccagtgatactttaacatgggccttcaagcacctgaataacagcaattacaaaaatatatttttttcatcaacgactgggcattttatgcgttttttttattttgcctattaaatatgcccttaaaatcgtgcttgttcctcagtctacttattagaagttcaaaacaaggctttggttcaaatccagtttctgagataaatttcttaattcattgtaaaaaatattaatggtgaccaaaattttaatgtttttagaaaacatcacaggtaatcagaacaaacaggaataaaaagaacaaagagtaaaggaaggagaaggaaggaagaaggaaaggggaaatataaggaggagtagagaatgaagaggtgaagggaaaagctgtgatttttattttcagataaagcacaggtagagaaaatctatgacattaggagagtctttcatttaaaaacctcatagttttaggtaggagggttcttattggtggaatctttcatacttgttcaatccaaattatccattaattgttctgtctgatttattagctttcatcaaataaatatcattttctatgctttagcaacttgaaatcatttgccaactgttgttatataatacaagtcgaaaaagttggtatgcccaaaggcttatctggattttgtattcattttttccattttgaagttcaaaacaagtcatttctttttctttattctctgcaatcaatacaaaatgtgtgttcatactattaagaagagcatgactgttaagaagccttagttcaatggattagtagacaaccatttttttaattagtcttccccctctgaacttttctccactttccgcagcaaatggaaacgtaatgagaatctcatagtattctgccaaaataaaggggatgtcaggcaataaagcatatccttgctaaatagcatcacaaatcccatatgtagaattatcattttatttttaagagttttttccaccaaaagccaagaataaaattgctttgaaggataattgttaaatggttatgctttggctctatatttgagcctccacgtaagtctttaattaataatttgtgctatggaccgtgttctgatgagatgttttgctaaggagatatgctcccttcccttactgccacccacaagagtaaataaaagcaagacactggcgttttggaagtcaaactgggattctgaagaagttcctgggctctgagtatcatgctacacagtagagagtcacttcctgcctctctaatatctaaaacaaaagatttgaactggtagccattgatctaattcaggcctgagatacatttggctagtttgatacaggacaggttaagccccaaaatcagggcttggcctgggaggattcttggctttgcctaggaaagaattcaagggcgagccagtggcgttaaacagctatgttttagtgaacattactgcgctttgtgaaatagggacaactcataggcagtgcctccaaagttggcagggtatgggctgctggctactgtatttatatccatttatacccactttcaattacatgtaaattaagtggcagattaatgcaaattgagagacaggttatttagaactttctaggaaaggggtggtaacttctgggttattgccatgtcctttgtaaactgtcatggtgctggtgggagtggcttctgctaatatgcaatgagggctgctggggatcacttttgttgccatctgctggtttctgctgtttttctcacttccgttggtcgctgcctgctggtacctgccagtttcttcactttatcctctgggaatgggaaataagtcctgcccaactcctacctcaggcttgcacagaatttttaattggaaaacctttttccagttacccaccaaatatacatcactgcctactatatatcaggcactgttccaagtgcttgggattcaccagtagacaacatgcacacataaaaaaaagtgctcaacttatgaggcaaatatatagtgcactgggatgttttacatacaactccagattcttaagttcctcttgaaaaataaaatatatggccaaaaatagctctacattctgacatggacactgctagactgaattgattagcagttgcccattttagactgggcacaggcgtgccatttgccagtattctttccaatttacacaatgtccgtatgcatttagatctttgcttcacctatttccattccctttcaggtccttgcaggtattttaattgtggactccattcactgtattattttattttatttcagttcagtttgtatcattttgagttcctgtttttaatttagtataatatcatagaaagtgtttgtacttaattctacggccgggtgcggtggctcacgcctgcaatcacagcactttgggaggctgaggcgggcggatcacgagatcaagagatcgagaccatcctgaccaacatggtgaaaccccgtcgctactaaaaatacaaaaattagctggtcgtggtggcacgtgcctgtagtcccagctactcaggaggctgaggcagaagaatcacttgaacctgggaggcagaggttgcagtgagccgagatcgcgtcactgcactccagcctggacaacagagcaagactccgtctcaaaaaaaaaaaaaaaagaaagaaaaagaaaaagaaagaaagaaaaagtgtttgtacttaattctaatgcagaatgttatggattcttatattggttctggtataaataagctaaataaatttaaacatgttttttaaactctgtgtggtccaaatatattctcagtaaagtaagagtttgacttatttgtgggtttgaaattgagttcagttgaaactcacaattcagttgagctgctgtaatttcagttttatggttccgtcttccttatgctatatatttttaaaagaggttttgttgataaaaaaaagaaagtttgtgaaccactgggctttctgatctctatgatctcctacaaatttaaacttatgtgatttaacactaatcaaaagcaaatcggtattcctatttaactttttatatacaaaggtcttatttccttaaaattccctaagttggaataatatcttaaaagctgttcttccatagtgtcaattaagtgcataataaactaaaaatatttgctgaaaatacatacacatctggtaaaattgtgttggtatgaataggaataataaatacaaaaatgaaaattgggaagagagaatagtggtgcatttgggaagggtggcatgtggaggagggcttctagagtattagtcatattctagtcaatttttctttaagagaagggccctcactctgtttcccaggctgaagtttagtggcactatcatagctctcagtctaaccttgaatttctgggctcaagccattcaactgcctcagcctcctgagtagctaggactataggtgcatgccactatgcccagataattttttaattttttcatagacttaatgtcttgatatgttggttaggctggactcaaactcctggacacaagcaatcctaccacctcagcctcccaaaactctgggattacaagcacaagccaccacacccagccccctatttcttaagtgaagtgattatgaggaatagctcaattcattattgctctatattccttacacatgtaaatcttatatgtacatctatagcaaatgaaaaaaaaggaattttcgttgatatttcctttaaatgaagatcacattggaggtcaaaatgtcacaccaaaaggaaagtaaaaaactcaaagtaaagatattttgttaaaattatgaagtgttaaaattgcaaatgacatctcatttgtaaatattgtattattatttattaagaattactcgaataagccaaaatgatgaaaatgcttgttatatagagaaatctaaaatgtaaggcagtaagcagctactcttccaataactccaaaagatgaaaatatgtttggtatactaaaaaaaatctaatctgtaatgtagtcagtggtatattttgaaagaaaagtaaaactatagttttgattatttataaaagaatgaattattttatatttaaaataattaagtcagagttaaatagtagtaacatgtaatttttaaaattgataggaagtgtatattatacaaatgtgataaacagcatttatactgtggaaaatttgtatcaatgacagaaggtaatctcccttcttactacaattcttttttaaagggaaaagaatataaaagatgaacaagtgtacagtctgaaaaggttaattttcttctttaaaaatttcaacactttgaaagtacctgcattcaacttctcttcaaaattattacttcttaaactacagtcagccaagcaatttgctattgagaactctcaaaatccattattaaatacaattttcaaacatacccagttttttgaaacacaaattttaactttgcttttgaaactgactgatgagaaattacctaactttgaaaaaatattcattaaaaagtccatattccacctagtcatgtgctaaatatcagcattataagcagctgtttcaaaacctagttttatgcaacatgtgccctttttaaaatttttcataaaatgtaatatctgttggtagcactactaataatattataggaaaacgctgaattacgatcatatagaaaattataaaatagaaaaataaacagagtttagtatagagtgtctgaacatgtgtaaagcaaggggtcagttgcggaggacgacttattgagatatttgtaatatcctttcatctacttttatctgttttatagtttcctagtaaattataagcagtgattacacccttaatctttggctttatggaaaagtataaaatcgctcttcagttttattatgactgtatatggatattctatttacaaaaacatatgctattacattttggccaatctttgtattaatttttgtaagaatatattgtgtaagtatttatagggtaataatacatatcatacgaatgttaagagtgcaatagcaaaataaagaaccatagccaaaataaattcctcataagcaagcatcacacacacacaaacacacacacacacacacacacacacacacacacacacgcagaaacatggacattttcttcactgactcagaaaaaattttcaggtaaaatgtcctgtaaatgttcgagtggtcacaagtaaaaatttacaaagtgtttctatagttccagcagaaagcgaggtgcattagaagaaaaatattcatgatatatttagaaagacaccaaattttgataaaacaagtggtaactcagtttaattaaccaaatatataccacatgcaaaatatgtcatagatactgataattcaaaataagtattctctaatttggaaattagcaacacacatttttgtgtatatatgtggacagatatattaatccatccctggcataggagtatcccaatgtactaatttgaactcttataaagcattcagttcaatataactcattaaatggccctacagcccaaagaagaagccatctttagtatgcatgatacaagctttcatttctataaaaagaaatggcaaaagattagatttgcaaagcaagataaaaagacacttgtcagctcctagatcttccaggaagcagcatatataggagaaagagaaaaaaggtaaaacatgattgatataggaaaacagctttacattataaattgtatggtgtctatatacgtgggaaattttctaaattaaaaacaagtcaagaaactataaagaaatttggccaggtgcggtggttcacacctgtaatcccagcactttgggaggccaaggcgggtggatcacccgaggtcaggagtttgagaccagcctggccaacatgatgaaaccccatctctactaaaaatacaaaaattagctgggcttggtggctcatgcctgtagtcccagctactcaggaggctgaggcaagagaatcccttgaacccgggaggcggaggttgcagcccaggttgcagcccagcctgggcgacagagtgagactcagtctcaaaaaaaaaaaaaaaaaaaaagaaactaaaaagaaattttcatttattatcagcaactaaaaggattaagtacaaagataatgtaactaagcatttagaggggaagactggtatgtgtaagggtatggtataaaaatcataactcttcagaagaaacaaagacttttgaataattgcaatgaaatgtatgtaggtagggtggggaaaaagtgggagaagaagggaattacagcagaggaggcgaggtagaggaaggcaaaaaccaaattacaaagggcattttgtgcaatgctgaggggtttatttttataataaaagctgtagggaaacgttaaagcattggtttccaagcctagctgagcattacagttacccagggagctttcttaaaatgctcactcccagtccctcatacccagagattctgatttaatttatcttgggtggagcctggtgattttcacatgtagctaaggttgctaacggctgtgttaatggattttaagtaaactacacaatcagatttatattgtggaatgaacactaatcctggcagtatttagactgattttggaatagactaaactgcactggatttcttatgatattatcattataatataggaaagaagacctgaagatctaaagtgaagccaggtagtaaggatggataaggagtgggagtggcattcatagttttaatgcgactggaacacgagaagcaagatatcatagtgattataaatattgactcgaattcaaactctactcctgccactttgttgttgtgtgaacttagacaagttacttaaccactctaagtctctttttgctcatatgtgaaatggaaataataatagctgcaccacagaaattttcaactgtcaaaccaggtaaggaagttaataatggataacaatatcaaagatatagcaaatattcaacaatggacagtcattatgaaaatctagctgtctcagtaaatgtgctggatgaataagagggaaaggtgtagcttggcttctagaatttatatgtaatcttttttcttaaaatataaaatatatagagaaaatctgtaagtcataagtgactcaataagttttcacaaatgtaatgcacccatttaaccagtatcagatcaagaagccgaacattatctaaacttcatacccctttcaagtcatgtctcctagggtatttatttggcccactaaatgtttagaaatagcaagagaaagattataagaagaggtgtagtagagaggaagataggtttaattttggataagtggggtcaagagcctgtgggatattcaaatggaaaattcaagaaggttttgagcagaataaagggtaagtcatagacactgaactgacagacattagcatcaaagcagtagttgacattaaaaatggttcttttcatattttcttttctttttttggagatggagtctcgctctgtcacccaggctggagtgcaatggcggatctctgctcactgcaacctccgcctcccgggctcaagcaattctcctgcctcagcctcccaagtagctgggattacaggcatccaccaccacacgcccggctaatttttgtatttttggtagagacagggtttcaccatgttggccaggctggtcttgaactcctgacctcaggtaatccacctgccttggccttccaaagtgctgggattacaggcatgagccactgcactcagcccataatgttttaatggtgtatgattcaagtgactaggcataatatgttgcttgtctcgttgctcaaaaagtaagaaaaataaaagaaagagactccactcttttgctaggtttaacattgtgttgttgtatgtatatatgtatttctgtacacatccctatattgggaccatatgaccttccacaaagaaacaatcttacttaaaattgttttaaataaatatgtaaaaagtactataaaattttacattattttgcgacagaaatacaagttttgttactgattagagatgcagcaacagtttgcttttcaactacattaggaaccctatgagcattttttagataatttcatagtaataagtaggaagtacataagacataggattcactaacttggtgagaacttaattgctcacaagagaaaaatgctagactaatccccttagcaaagaatctatgattaaaagattctaaaaaataatttgaacaatttccagttaccataaaaagacatggttgagaaaaatgcaactttttgctattgatattcaataaatgtttactatatatataagttggggctgagtctttctttcattctttgggtcttagcataaacaccacctcccccaacaccacctgctctaaattaggtttcactggccactctcttgtccccttgtccatgagagcacccaacataatttgaaagtatacatttaattgtttgttagccagcttattgactatcttctccttaatggattagtttgtgaaagtttagaccatattcatttggttcactgtcatattcctggcacctagaagggttgttgacgtattgcagagattctcaatcttggtgctactgagattttgcacaagatgattctttattatggtgggttgacctgaacattattacatgtttagcaacatccctggtctctacccactagacaccagtagcaaacatctcttcttttagttatgccactaggaatctctccggacatggtgaaataacccctggacggcaaaaccacccagagttgagaatcactgaataatttaatacataaatgaacaaatgagtgagtgaatgaatgaatgagttaatgaataactgtctgattgctcagaaaacggaagtagaagcaggagcaaagcacattccagtcagatagtgatatggtttaaattcatgtccccacgaaatctcatgttgaattgtaatccctaatgttagaggtggggcctggtggcaggtgattggatcacggtgtttctcattaatggtgtagcaccatccccttgatgctgttctcgcgatagtgggctctcacgagatctggttgtttaaaagtgtgcagcacctccccacttgctgtctctcttgcccttgctcccaccgtctgagtcacctcgctccccgtctgccttctgccatgattagaagcttcctgaggccgccccagaagcagaagctgctatgcttcctgaacagcctgcagaaccgtgaaccaactaaacgtcttttctttataaattatccagtgtcaggtatttctttacagcaatgccagaatggactaatacagagggaacagtaaataagtagacaccgagggacttgaaagcttattacatgcaagaactaagacagagctagcttgcctggagctacaagagcaaagctgaattgaaatgggcgagggaggcatggtccagttatgtaggtcaaggttaaaaggtttggaatttactcttggtagaatgagaggcgttttaatgaagaggtgagatgatttaattgatctttctaaaaggttgctccaaatgctgaaattaggatttatagatggggtcaagactacatgagagagagcagttaggatgctatttcagtactccaggaaggagctgatggtacacagaagtgtcaaagttgagagggactgtactaatttgtaggccaagccaaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttgattcagtgacattaatatcatcatcaaacggtattataatttctcatattttaatctcctgttctaccatgcagcagagcacagctgcatattatattttccatgggaaatatcagccatcatatggcttgtagtcttccaaatttctggcctacttttcaaaatcaaatgtctacaatttccaaaaaacactgaaaatatttttaaagtacattttgcaccaaacattttaacttatgagtaatcaacctttacaacatttgaacgtaaaacggaagtgctaaaagtctggcagcaaaaacaacctttcagcattttatgagagatcctgtatcgtcatattggtgaatttaaaatgattttaagttctttctttcttctcatgagactttagatctaagcagtctgtctttagcactaaccgggatcacttcaatgcaacattttcatggaacacagcatttgctgtcaatcaataagattataattacaaaataatgatgccttacagacccattctaaaaatactttgacatctgaatctatgaaagggctcaaataccaaaaaggatcttccagattcacatgaataaagttcctgaggtagttgatattttaaaaattccgtgtcatgccaattatgtgaacctatgctggttagatcacacctgaaaatttaggatgtattgtcatggtatgtgaactgactacaaaaggtatcaggaggttgatatttgctacataagagaaagatgtgttcaagaaatcctcacacctttgcatctcactaggcaaatgggttaattacatctgaaatcatatttcgatttggttgatagtctgataagttaatttaaggtgaccctggtaccatctaactgttttgtttttattccaaataggatattggccctttctaaaaaggattatgtagtcttgtctatatgagcaaaaaaaaaaaaaaaaaaaaaaagtaacctgagtataactatggtactaagaaagaaaatcagtatacacaggtaggatttatctgccataaagaatagttcactgctataagaatttcttacaagaaactctactggataatcaaccttctagtcaaactccagggaattcaatgtagtttaaactcaatacatattagggaaatcacaaaatgaatcatatgtagtcattctatggatgagttcacaatctagatagtatttccgtgggggtaatgaggagtatctcgccacgtcagaggagtgagtatccttctgccttcttaagtataacacatatagttaacataatattttcttgaagtaacagtagagagtcaagccttgtaggagaacagatattttctaccaagtctcagcttagtctgttactcagttttcttgccatagtactctgcaacatgctgaatccacggtttttgtagaaatgcgtccacaaaatttatgccatgaatgcaacaaaaaagcagtacacacatccagtaagaaattgaattcaatcagtagataagcttggccaaatatttgaaactcaaaaactaaatcattaattgtgcaaaagtaaagaaaaagtgggaaacgaaattaatgtaaaatattccaaaacattcttactatttttaactaagaaagcatattttactgatgtctgcaagccttttgttcttcactctttcaattctctaatcctgccatccaccccatatctttctttcatttggaattttggtttacaacactcagttgtagactcaggcatataacttgtgttttagtcttattcctttgcacaaagacaaaatacatagacaggacacattgatcagaaaaccagaaataatctatttctaaaatttctaatccctgacataaatgtatcaaaatcacacaataatttaatagaatgagaattgcacacacacacacgcggcacaataaaacccaaggtaaaccaaagcacaacaaatgtccttctgaacaaaaaggttttccagacagctgagagctactcctttggatgacagaacacctcaacttctggatgaaaggtttacatgaaaatgattatgtaggacagctctctttcccttcttatgtatggtatgtctaacataatattttcttgatgatttagggttagaattatgatgtgaagatatgactgtggaaggattgatcccaggtacatgtggatgttcacccctagaatgcaatttctttttcttttattttttttagatagagtctcacactgtcacccgggctggagtgcaatggtgtgatctgggctcactgcaacctccgcctcccaattctcctgccaagcgattctcctgcctcagcctcctgagtagctgggattccaggtgcccgccgccatgcctggctaatttttctgtgtgtgcatttttagtagagacggggtttcactatgttggccaggctggtctcgaaatcctgacctcgtgatccgcctgcctcggccccccaaagtgctgggattacaggagtgagccaccgcgccccgccctagaacacactttcttagaaagtttcaaaatatctttttactgttacagtattttaggaatctgaacacttattagtaaaaggaaatatgaacttgctttctctcaagtagtatctttctttctccacaaagccatgtcttagagctctttcaattatgggtattaaaccagtatgaccagaatctcagacaacagacactatcctgtccacacagagctaatgtttatccctgtctgcagtcttcatcaacagtttggaaaggaaaagtcaccctcgctatttcaatattttaagctgacacattttacgaattcctttacactctaaaagtggtctatatatttattagataggacttctcaaggcatgatatagcctagaattttctggaacctctgaatcctttattgacactgaaggtccatgatagtgcctgcaaaatgattgaacaatactaaatcttgtaaacaatttcacattatatttgtaatgtaccacagtcattgatcttatgaatgatggtgaaactggcggtgggaaagagaggtaaacacaaaaatgtgtatcctaacactaaaccagtttcaaaaggctgtgctcccaagttatcctagccataacatgttctgatttcttactttcacattaaactctgtatagtatattgtagaacttaattcatatctgctaaattaaatgagtgaatacataaaacggaaaactgaggtaaattgtgtactacttacactaaatcaaagtacagccttaaaggaatatacatttaataatgagttttattaaataaaaataatgtattctaaacaattgtctgcatttaaaacttgccaatggaaccatgaaaaaatgcccaaactcatttttcattaatgcaattcaaagtaaatccacagctagaaacaattttatactcaacagagtagccaaaagttaagtttgacattgtcaagtgttagaatttgggagcaagcagaatttttaagttcgtgagaatttaaattggtgtaaccaattttaaaaataatttggcataatcttggaaacttagaaatacatcatgtcagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgagatcattcattggaagctgcagctatagtgggcctatctggttggaggggggacatcaaagcatatgcagctgttgccaaagatactgcctgaaacacaaagagaggaagagaagcactcttgtgtcttccctgagtttccaatccttcaccatcagccaaagagagctggaagtcacctggaaatggaagcctggcacacacagtctacaaaggtcagtctcccagtggtacacagtagagcagtgtaaaggagccaaagagtataccagagggcacatacatgggccctgtgacccagcaatcccactcctacatgtatacaaggaaccttgtttgtaataggaaaagaattaaaactggaaacgaccctagtatccatcaacagtagtatgcataaataaattgtgggttatttctatgacggaatatgacataatgctgcagtcacagacatggatgaatcttagcaacataatgctgattgaaagaaacagtcacagaagaataaatgcaatatgattccaactatacgaagttcaaaagcatgcagagcaagactatttctcttttagtaatacatatatatgtagcaagactataaaacaaagcaaatttcacgaccaccgttatctctggtggtagtggggaagcgatggaattggagatgggtacatagatggcttcaagttactgtggaaaattcgaagtaataaacacatttggttatgattgaaactgtatgtcttaaaatcttttgttcttatgtaataagatatttttaaaagacagatacatgtttaactgattggcaagttagtataacaacatcaacctaaaagaaattaagtttatttttgtttttgtttttgttttttaaatctgaaaagcatttccctttcagcttgctgggtttcttgcactaaaagatgagggtttaataatcatagcagatcagaggcttcagtagggaggagatgggatagcttattgtgaaaaacgattttccccctagtttaaaagtggcccctggtaacatttttcttgaagcttctagttatatatatcgttgtcagtcactttgcaactttgaagaaacagttttcctgccgaagggctctattatagttaatatgtgtctacataatacaaaaagtcatttaaaaattattgctttaagaactatttattgagtgcctcctaagtacataacatcaaactgtgaatttaaagtggacttgcataatttaatcaaaatttatactaaggaaaacaggctatagggcttttcgatactacaatacctgaaaaatgaaatactacagttataatccacatgataccaggtatgaaacattcagtagcagtgggctagagctacaggttaccttcttgagacacgttgtcaaagaagaccatagcactaggtaattgggaaatccagttggaactgtgtagcagacactgcccactctgttggtttacctctggcttgatcagccctgtaatggagagtctcgggcatgctaacagcccaccaggtcaagcacccactgcttctctgtgtttcagcctcacgactttgtccaaagttatagaaactcactcatccaacacacaggaggggacctgatgtccctgagaaataattaatgaggcacaggaaccagagacatattccccagcctcttattcttcagagggacaattatgagtacattctacagcattcctcagaggggtcttcacaggattgaacaacagtttcccactgcagtagccagctgaataatacactcactattgttttcccccgtttttccttacttcccctgcctcccacttgtgctccctgtgatcagctaccaaatgagctagttgctctctagtcctcgcctcaggcttagcttttaaagaaatccaaactaagacaaactgtgacaaattacaatccaaacgagattctttcctctcagggggatgcttagtccccccatcaagcatcattatcaaaatgaacacagactgcagaggaagaaaatatttgccttcactgagcaaagtcagactcatgaccctcaggttagagacacagagaaatgcaactaactctggggtgaataggtacagattcagagtggaaagactttaaaacagcaataaagtcctagaaataaaaaaagctgtcagctcggtacagaccagagcttgagagcaagagtactaagcgactcatagaaaaggattcaggagggaccagcacagcgactttaggctcatagtaacaagcaacagtttgctttggctaaagtttattactaggtgtggacaagcaagagataaatatcggaatctgtgggtacagcctttggatttcatgccatggcaaggtaaaatccatctgcaacatcaaaaacagagaggcatttgcaaaaggaaacatgaggagaatgttcctagcagcactgcccaaaataacacaataaacgaaaaatcttcgagcagcccaaatgccctctggcaggaaaatggacagttaacctgattacatagtagtcaaagaaacgactgctacacaaaacaatcaagataaattctagggatgggatgatgcatgaggaaaatatgagtcccaaatatctttttaataacatttaaatataaaaacaaactaaaacattttgtgtcatacagtaaatatttttaatgttctcacatatgttcacaatagccctatgacatatttactattattgtccccattttttttttggatgagaaaactgaggctcagagaacttcagtaacattcccaaggtcagatatccagtaattagtgtagacagaattcaaatccaggtggaaatgctctgaaacccacagtcttacctgctacactaaactggaacaaatattgttgaaacatatgtatctgataaaacatttaaaaatattacaggattataaattcaggcaatgtttactatcccaaagttggggggacatgggaagatggcatgaggaagctgtgctttatgtcattgccaactttctagtccttcagttggtggttaagtggagataaggatgaggccagagaacatgagtggcacgaatgcaagattacatcttgtattctcttaaaattttaatattttgctcatatgaattattttgcattgattttaattgttaaaatgaggtaaaatataatttatcctgatttctgaatttttaggcgaccgcttacattttgtgattcagacatagccatcttttctgggagaggaaggggaggaggtacacacaggatttgtcttgaatgtaggtttccctattttcagagattgtatatttgcttcctgtggcttggtgtgaggtctgatgaatgttaagcgaaggctaaatcaccccctctctccttagtaccaccactgaagtcacttctttctggccttaagttcaaaaggggaaactgaatgatgagtattgagcatctacactgtgtcatggcattagtaattgttcctcacttgactccctcagtagctacataaagtaagtcttcttattctcatttcatggagtaagtattcttattcccattatgtggaagaataatacttaaagtattcttattcatgtattaaaaactgaggctcagaaatactaagaacattgtctaagggcaaatatttcaagtgccataaattcttaaacttcatgggtattttgtatgatttttcttttcaacctcttttgactgggctattctgggaggtggtcacagctattagggccaaatgaattaaaatatatgaaaatgattgatgaactgtaaggcatcatatcaacataaatatagtataattaataatgtcaataataaaatcatttacttctacttctagtattcagaagagaggtaaaggtatattttgcctattttagagtaccatatgaaatgaaataaaatattattatgaagaaaaatttactcttttcacattgggaaactatccatcagagtcaacaatcattgtcctccttctctccaaaatagaacatgctgaggtttatgctatatttttgaactatttctattaacacaattaaaatgctgaaatgaatttgaaaagatgtttatattctgacgaagggtaactagaaatattttctactctaaattgagtcaggtgtgatactgtaaacaggataagtaaaaatataatataaaatttcaaaatttactacttgattccaatgtccagaaaagaatgaaaatataaatcatataaaactctagccaatttaagcaactgtaatccctttagacatcattaaatttactttacctctgacagtaggtgataccataaatgagtaagaacatattttaaatgtcaatatattgtctctctggataatatatttgatggttttatataccttactaaaacccatagaaactttttaaagatgtgatattagtgttgatatctattgaagatataattggctaaagtttaaaaaagagtaaaatatttttttccaagcacagcccagtaatattggacatgtgatctttgttttttactgttgtcataagcatatagaaagacaatttagcaagtgttctgatgaggtttaaagagcattttttctagtatatggtagtataataaacaataattcattgtatatttcaaaatagctagaagagaataattataatgatcccatcacaaagaaaggaaggattgagatgatggatatcccaattactctgatttgatcatttatacagtatatacatgattaaaatattacatgtgatatactttggctctgtgtccccacccaaatctaatgccaaatagtaatctccttgtgtcaggggagggacctggtgggagatgactggatcatgggagcagatttccctcagacttttcttgtgatagtgagtgagttctcacgagatctgatggtttaaaagtgtggcacttcccccccccccacatcccccagctcctgccaccatgtaagatgtgccttgcctccccttcaccttctgccaagattgtcagcgtcctgaggcctccccagtcatgtggaactttgagtcaattaaacctcttttctttataaatcacccagtctcaggtagttctttatagctgtgtaaaaatgaactaatacaacatgtaacacgaaaatatgtacaactatgatatatcaaaagctacaaactatttttgtttgctcatttactatatatcttagatattttggaaccaccaccaccacacatcacacacaaattcacaaacataacatgttataaaacataggaaatcaaatgagaacatttcctaaggctatgctttttcaactggtagttggggaggaaactgaatttcaaaatctccgctctataatttctctctaactctatattgtcacttctggggaaaaaaagagaagaaggtaaattgcatcttctggctctattcagaagaagaaaaaatggttggtgatctttgttgtatggattttatctgatgggtctcctagtttacacttagatttgctgaataaatcctcctcatttccagaaagacaatatggctttgtgggagtgctgaaggcacatctttgtcagttcccactatcggagactcccagtacatcctgtcatgccaggatttgctctgcctgacaagaaggaagaagcttatgatagctttctgaatgactctgaaaaatgaagctgctctgcaggtatcatcactagaccacagataaactcaataacattcatctgctagaaaaaaaaaaaaaaagaaagaaaagggttcacttccagatcagcctttggtagagataggcagtagggacttggcagtccctagtcacattcaaatgaaggttcgacctattgtgctgaagtctaagacaaaggtgcttatttagatttcctattttatggctaaaatatatgtgactgtaggaatcctctgttggacatacgcatacacaccaacttatctattgcaagggtctatattattagtatgactgtatattaaataattttattatctgaaaaatttgagtgcattgaagataaaactgactcctgaaatctaagtcctatttaatcaaaacttgcttcaaaaccttcccaaagtttcaacatgtattattttttcgtgtgtgtgacaaggtcgcactctgtcgcccagatggtgcagtggtgtgatctcagttcactgcaacctctgcctcccgcctcaagtgaaacctcccacctcagcctcccaagtagctggaattacaggtgcccaccaccacacacagctaatttttgtgggttttgcagagatgaggtttcaccatgttgtccaggctggtctcgaactcctgggctcaagcgatctgcctgccttggcctcccaaagtgctggcattacaggcatgagccactgcacccggtcaacatgtattcttaaacagatttaaaatgctttcttcatagcattaaaaatgtttcacaataatttacatgagaactctatggaagcttaatatatttccagcataggatacacacaatgattcaatgtcctggcccttgaagtacacataattggaatgaggagaaggacatttggaaaataattaccatgcaatatgatacctgctattgtacaggttcttacaggtgctacagaagaatcaaaggaaagggagactaattccacctcagagaattaatgaaatgtatcacggcaaagatcagattttgtctgggtcccaaaggacgttcaaaagcttggtaggttgagaaagtgggaaacagcattccaggtctaaggagactgccttaaagtttaagtaggacagtcaaagagtggaggaaataagtcaaaataggaaaatgacaaaaaatagagaaccttgtaggccaggcttaggacttctaacttaagacaatggagatcatcaaagaccctttagatgactaagtctgagagcagtgtgtaaaaggattggcttgaaaagatcaaaatcaggaagtccagatagaattgagaagactatggcaaatagtgttggttgatgaaaaggcattgttggtattaatgggagattccagagatactatccaacctgttttatacttttttgatcaggttgcatgtctaagaacatccctaggaagtattacttttcactgcattattttttactattcaactataaagtaaatggatgcatgtaactgttgagcctttccttgcactcatgccataaatgtaagaacataaagctacaccttaaagttaccttttagctcttttattttttatgttttagtagtattcagtctattctactgaattcagtcccgatttgttatattttatttactcttcaaagaaagtttttcaaatgacaattgaaataaaagaagataccatttgttctgtagattatctacattccaattcctatttcctaggttccctattctaatcatctacttttctatattttcttcatcaccaaatacaggcagtcacaggcaagtgcaggagttaataatcattgataaattacatgttatatagactttgatattcaatttctctggagatatataactatatatacccttctttccctcagagggctttaaggaaactaaatccccaaaactaaaagcactgactcatggtttaaagggtaagttaaatctctctgtaaaggaaagcctaaatgtgatctttgcaaacataactggtgatcaatagccgaaagattaaagcagtacatatgcaaaaaggaagattgaaacttaacattttgtttattgatgtcattcttagatctcaattaatttaatttgatacatcaacctccgtcctcaatcaaacactagatggataaagataatcactattatgtaatagtcaatacgcccaggtgtctcctggcatatatgatctattgaaatacatatattattatattttaactaagaaacacagtatctaacccaagtattatgtacattttttaaacaattcacttccttgaaagttatgagttaccaatcatttttaataaatttctcccagctttacatttatctatcaattatatctgaacttcaaatacactctggatgcatttgtctcagagcaatgatggtgtctaagcttgcagtttctgtgtctgtgaaattcatttgcagtaaattgtgaataaataaatgcagtaaaaagcctaggctccttggagagtctacattctcctccctcccatctctttctctcttcttctctcctaccctctcatcctccatctgtccctttccctatccttcttatcacacatgggaaaaactcaattgaattaaattcagtctaccagaagtatacaattgaatttttgataaacacaccagaaattagatgtgtatgttcatttattccttccgcacatatttgttgaatgtttacttcatgccacactatggatcaagcagtgaagataaaacagtaaacaagacatgcaaggaaactactctcatggaacttccaatctattgtagggaatagcaaataaatgacaaaataacataatcacccaatataataagtgttattgaagaaataaacaagatgttcagatagaaagtacctaaaatagagagtccagggaaggagagagaactagtctggatttcatagtcaaagaaggtgtttttttggatgtgcaattaaacagatttgaaggatgaaaattattccatcatgcaaaataatagcacaagtttgtccaggaaagagcctttgcaaattccctgggatggaatagaggccttcattactgtttggaacttctctcttcaatctacctttgtagcctaaaaggcatttttaaatatggtcaagaatgttgaaactgtttttcttgatagtgtaaataaatgtatgaactactcaaacaattagctatagtgataaatcgaataagttggtaggtttgaatatgctggataacactgtttctgataccacctagagactggttcccatctgtcaactggttataaaacaattttggaaggaatattataacttgcaaagaaaacgaacagaattcagagaaaaagtaacaaaaattgctcttaaatatttgaaaatatgttcatcctcattcctgagtagataagtgcaaactaaaagacatagtttcatagtttttcaccaatcatattggcaaagatcaaaagtttggtagtatactgcgttttttatggtatgaggaaattgatgttctcataccttcctgacagatttgaactgatatacgtggccatgtgtatgactatgcgcatgtatgtacagcagatatctgaaagaatacacagaaaaccgcaatgccagcacccccagtaagagagaaggaggataactaggaggctagctaacataataggagaaacaattttctttatgcgttcttttttgtttacctctatgaattttgtactatgtgcaattaactaggtaattggagctttaagagcactttgggggtcattaacactaaaaatattttacatagaaataattataagcatattcatccaaccatttatttatttatccatgcacccatccatccattcatccatccatccgtttatctcttcatccatctcatgtttaatttgtataaacgtttatttatcccatagactctatgtatgtatggtacatgtaaggttatataagagatacaatgttaaataaggcagtttctactatccctaaatttacaatgaaggagaaaagctacctcatgattacagatatgaagggtttggtaaatgcatcaccaaggcttacacataagcagaaggagagggtgcagagagctaaaaggctcccccaaaggactgaaacttgaaaggaattctgcagataggtttgaaagccctgacatgatttttttttttttttactgtttcctattgcatattcttttgtccctttcaagtatgaaaattcttataatttccttcaatgtatactctctaagtaataaaaacaattgtattctcaaaagctaacaaacaagaaagcaagcaaacaaaagttcaggtatcacatttgcagtaatatacaagtgctttcattaaaattatgcttttatgtgtttacttagaggagtcttgagaaaatatttagacctaccccctaagctttagggaagtggtccccaacctttttagcaccagggactggtttcgtggaagacaattttttcacagacttgggctggggagatggtttgggaatgattcaagcacattacaacatttatcattaaattctcataaggagcacacaacctagatccctcgcatgcgcaggtcacaatagggttctcgctcctatgagaatgtaatgctgctgcttatctgacaggaggcagagctcaggcttgcccggggctcacttcctgctgttccccctggtttctaacaggtcacggaccgattggtctggggcccagggtttggggacccctgctttggggacccctgctttggggagaacagcataaaaaggcagcatttctgaaactgttctagatttttatttttctgtcagtaaaatggttgtagtattggtatataaatcttacactgtattgtagagtctcaataaagttactcactgaatgaatattttaaaaagttttcccttattaaattacaaaagtaaaataggagtactataacataatctacataaataccaaatatgaattgatatatttttcctatattttaacagaaattcttcttgagagaaacatagaattctatgtctcctatttatagacattaactgctacattttgcacaaccacttttaccgttagaaagagaactgtactttgatggttacatagcaccttttcctcatgtacaaaatactaatgctactaacaaaaataattttaagtgatcaaaatatgaaatgtaattatcaaaccccattatgaggatgaggttaagataaagtaaaatcatctttgtcagggtggggcgcagtggctcacacctgtaatctcaatactttgggaggccaaggcagggggatcacttgaggccaggagttcgagaccagcctggccattatagcgaaaccccatctctactaaaaatacaaaaattagatgggtgtggtggcacacccctgtaatcccagctactcggtaggctgaggtgggagaatcgcttaaccccgggagccagaggttgcagtgagccaagatcgcaccacttcactccagcctgggcaacagaagtgagatcttaaaaaaaaaacaaaaacaaaaacaaaaaatcaactttatctatgctttgctataggtgttaacgataattgcctattgtcctacatggatgattttattaatagtgattacataaaaaaatgaaaaactttctgtgtagtggtgatgtaaaaagatagttttcatcacatggatttgttatatttttaaaaagataattcttcataggtttttcagggattgtctggttttatttgtttaatgaaaaataaatgaggtaacgtctcattgtaaaataagagtttaaattttaattaggaaaagatacccaagacagaaatacatttaaaataagatagattatcacttttaattatagaaaatgaagctttccagaattatgtttaaatttatagatgcattaaaaactatcaagtttaaacatttaagtacctgaataatgttgagcaaatagcaactttggactatgctggcatgaggagagtgaggaaatgccacgataaaaatcagaaattattaaagaagtccttgctttcttttgcttacaaaagattctattgatattgaaaaacaaaccaaaacaaacaaaaaaatggctacggcatctggattcaaaatgtttccataagtctatggatgcaaagtgagtctcaattttatgaaataagaaaaaagaaaaatgttagctagaccaggcatgatggatcacacttgtaatcccagcactttgggaggctgaggcgggaggattgcttgaggccaggagttctagaccagcttgggaaacatagcaagaccctgtctccacgaaaaataaaaagaaaattagcagggcgtggtgtgcacttgtcccagctactcaggaggtgcaggtgggagaatcatctgagcccaggaattcaaggttagagtgagctatgatcatgccactgcacttcagcctgggtgccagagagagatcttgtcccttaaagataaaaataaaaaataaatattagctaacctactagttttacctgagttccttcagtggattacaacatatttcaaaccacagccctattgaagttaatttctgtgtgatggaatttattagctttatgttttaaaatacactgattttctcctctgaaagagtgagaaaatattctttagaaacagtttacattacaaactctgatgagtggatatgaatactttgccaatgaaatgtgtgtggatacttggaaattggctgggacatgaataaattgctcaaccctattactgtacacactgaagtactattttttagtacttcagcagtaggtcagcagtagaatcctcatatccccaaagaaagaacattataaatatatgtgtaaatttttagcataaaacgtgtttaaaataaaatattaagatggaatattaagtataacctgaatattaagaacagatacactcggaattagtggggttggggaaaaagtagaagacagctctgtggccgatggttttggtaataatgtttagggattccaggaatatgattttcaatgtcatagtatttttccaaatgactaagtaggtttttcaaaaactctgggtttttttttttttttttttttttttttttagaaaaataattgatggactcaatctgaaagttattttggcctaccatacaaagcctatgcagttctcagtatgtgacctgctggaatgagtgtgaccacctcagtagatactaacgttgtactggcaatacttttaagtttaaaaccacaacattgtattccggaagacttctattttgagtcttttcattctgatagtatcctccaaggaactttaaagaatagaacccctgattcaggtaacaagatctgaatgtttgggatgcatcagtgagtagaagcaattcacgcactttcagaagtccttaacttttgggcccctcaagtaactggactgtaacttgaatccagtaaatgaactacatgaaactgtcaccaaactaaagcaattgatgaaacagtaacacgaataaatataaaaggcactgctaaaaaggctttaagaaaggctttttaacatttttgagggaaatagtatgtaaaagtgtagtacatgataactaaaattagttaaattaattgcaggagttactttaatcaccacatgtctacataacaatctaaactactaaacgttataatcttcaagaaaaggctacaactatgaaaaagagcattggtgaatgtattaagtttgatagtaaaaacaaaacagacaaattaagctgatttggccattgattaacttttggatattgggggacataaatatttatggcttgttttctatatctttaaattgagtatggatccagcaatcccattactgagtatgtatcccaaagaaatgaaatcattatattgaaaagatatgtgcactcccgtgttcattgcagcattgttcacaatagccaaggtatggattcaacctaaatgtccatcaacaaatgaatggataatgaaaatgtggtcacacacacacacaatggaatataattcagacatgaaagaagaaaatctaccatttgtgacaacatggataatcctggaggaagttttgctaagtgcaataagccaggcacagaaagccaaataacatatgatctcgcttattataggtggtatctaaaaagttgggctcatagaagtagagagtagaatagtggttaccagagactgggaggagggtgtgaggcttgcagagatattgatcaaagaatacaaaatttcatttagacaggagaaataagttcgagagatctattgtacatgttgattctacaggtggttcataacaatgtattatactcttgaaaattgctaagagagtagattttaagtgtttttcacttggctgggtgcagtggctcacgcctgtaatcccagtactttgggaggcggaagcgggcggattgcctgagctcaggagttcctgaccagcctgggcaacatagtgaaaccccgtctctactaaaacacacaaaaaattagcaggatgtggcggcgtgaggctgtagtcccagctactcaggaggctgaggcaggagaatcgcttgaacctgtgaggcagaagttgcagtgaaccgagatcaagccactgcactcctgcctgggagacggagcaagactccatctccaaaaaaaaaaaaaaaaagtgttcttcctacaaaaaaataagcatgtgaggtaataaatatgttaattagcttgactgagccattcatatatatatattcaaaacaacatgttgaatgaaataaagataaacaattttttctatccattaaaattaactatttaatttaaataaaataaaatggatttgatcatcctaacacatttactaggttgttataagatctaaacatggcatcatctgcagaggtcttggcttaatgtctgacatatattaattgcttagcaaatcgtagctgtaatcactaaataaataaatttattgacttttttattccatagtacccttcgctacattatttgtatctctacttcgtctactgggaaggtatgcctgtggcagaaaagtttccatcttatctagcctttctcacattcccttctgtccaaatcattccagcccactctgaatctaacttgttttgacagagtacttatttacttggcacatgataggttcttaataaatatttgtttattgccttataggaagaaagttatgaaggaaatataacttgtttactgaggggtagcaagtttccttctttctttcttttttttttttttttttttttttgatggaatttcactcttgttgcccaggctggagtatgatggccagatctcagctcaccacaacctccgccttttagtggagatgatgtttctccatgttggtcaggctggtcttgaactcccggcctcaggtgacccgctgcctcggacgcccggccgcaagtctttcttttatcttactaaacacagacaaatgatggagaaaaagtctgttaagcaaatgcatactgtcttggattatttaagttttcgggtatttaggttgatttcccaactaggatatcctggaaacagatttaatgtaaatcatcttatcccttcaatctttagattctgtattaatctttctaaaaatttgctcttatgttcttctggaacatttatatccctaatagggatggtaaatctgataatctgatattcaaggtagcatggtgcacacacggattatttgatttagaaaaaaaatagacatgtgtttccctaaccgcttgtaaaatgcagcatgtatataaatcatctcatgtattaggcagtttccattttcccaaaagaaaatatgcctgtgagccctcaaaaatattttaggccaacatgtatacacaaaattttaggactttagcaaatatatataatcaattgtatgcatgattttgataagaaattgatgccattaattttctatgataaaaatattaaatatttttatatttcatatttatatcatataaaacattagaaatattagaaatgctggcatgttttttagtctcgcatttcatgaaatgactttattcgatctctttgaaagctactttgaggtaatttttttctttgtcataagaacccctttttttaatgtcatctagaagcttttttcagaacccatcaactccatttccagctacataagttgagataaattactttgtgaatatgtatgctcttcgtcataaaaatttgacctcacgccacactctgcttgctagtaagaaagctgttgtttatatttttccccttgtcttttggtgtatatttgtgaattcaatagcatgactgcttactgttttgtatatgtggatacgtaggtatgtgtgattttttaaattatcattaacaatgacacctagcaagtaagaagatgaagtcagatacctgggaataatctaacattcaatatttgccttcagtttttcaatccgtttcatcaggtaacctacttacagatgtaaaacttgcaatgatttgtcttctaaacagtattatcttattcagagtaaagcaattgagagttctttctaaaataagagatttttaaaatataattaagcaactttgaacaaattcacctataaggagacgtaccagttataacactgttaacttacatggggttggggtaattgcttacaatcagatattctcagacattacaaactttaggttgcagtactacaaacaaatataatgaaaacggtgaataaacatttgtttatgcatggctttattcttttgttcaccaattccttgttctgtttaaacacattccaaaaacatttacccataacgtaaaggaaggtatgcatagatataatttcaaacattagtcaatagcattcagtgactgaatggatttcgggatggagaaaggaatacaaaaataagcgacttcagggatttcagatataggagcctggaagcagtggtgcttaatagaaaggggaaagagtcatgaagagctggtttatgtgggagtagataatgagttccatttggtatatttaattttgagactgatggggggacacttaattggagacgttctgtaggtgtaattatattaagaaggggaaaaattcaattagagctccaccaaattatatcagctgtgtccaaaccatattgattgcctgtgtgtatagctggtgtgcagtgtagcagagctgaatgctactaagctcccttccgttctacgttttttgatttgaagaagaatatggagggtgacatgctggaaagaggacatgaccagcagctttctctctctctctctctctcactgttcctctggtttctcctttgtttcctctactgcaaatggataatactgtgccatgttcaactaattggccatagttactgaggatatcaaaacccatcaagcacagatacttttcttttatattattattatattttaagttctgggatacatgtgcagaacgtgcaggtttgttacataggtatgcacgtgctatggtggactgctgcacccatcaacccgtcatctacattaggtatttctcctaatgctatccctccctttgccccccaccccctgacaggcccaggtgtgtgatgttcccttccctgtgtccatgtgttcttgttgttcaactcccacttataagacagaacatgtggtatttggttttctgttcctgttttagtttgctgagaatgatggtttccagcttcatccatgtccctgcaaaggacataaactcataattttttatggctgcacagtattccatggtgtatatgtgccacattttctttatccagtctatctttgatgggcatttcaacttacaatgaagttacatgctgatatacccatcatagtttggaaattttgaaacttgaaaatgcatttgatacacctaacagactgtacatcataggttagcctagcctatcttaaacatgcttagaacacttacgttagcctacagttgggaaaaaaatcataaaacacaaagcctattttataataaaatgttgaatatttcatgtaatttattaaatactatactgaaagtcaaaaccagaatagttgtataggtcctcaaagtatggtttccacagcatgagtatcactttcgcaccatcctaaagtcgaaaaattgttaagttgaactactgtatgtcggggaccatctctgtacttgaaagtagtcagaaaaccaaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctataaaataaatatgattcattaagagtgtaaatggaatcctaataaggagataaccctaaatttacgatagtcaggcatgttgtgcaacagagaaactgtattctgtaattgctagggggagagtgcgtggttactgtcgatagttgcgttatttagatcattacattgcataagtaatgtatgcccatattgatgtaaacgttatgcaggtaatgcatatttattacaaataaattagaaaatagagtaactgtgttattctgatttgctgaatcttttgttcacatgtaggctgaggtataaatcaacagaataaaagtgtttttatggctaaggtcagtgagagattcaaacaaacgtataagcatataagtgtgcttatataagtatgtattcatagtcacacacatatactcacatgctaacgtatcaattgatttaaagttaattttatagggggttgatttgtcacattatcaaacactaaagaatgtatgagtttttaaaatgtccatgagtgaagaccaaatgccagctaactgagtgtaacatagaatataggtatattgaaagtattcatatcaacttatatttcatcataaagctgtatttcattttaaggtttgaaactccaatatctactgtgtcaaagcagattgagtatataaaggaaatgggttcagtggtagctatgacaaattaaattttgcctgcttctgtaaagtggaaagtccctattcagaaccagacaattgttactagaactaaaatgagggtctagaaaatctattcaaatatacacacacgcattatgctaaacacaaacgtatctgtccttatcaagtaaaaataatgagcaaacatctgtgcatgaatgtaagctcagtctactttatcagggctatttccgattttggctgatagatcagtttccttattgatatggctacaatagaatccatttgaatgagattttgtaaccataaggaattgtattttgtaaggtggggtcacaaatcctttcctgtttcaaactgattaacactgatactgctcttttgtgaaaattgcctgtgtgcaggaccatatttgaaaatttgaacaataaataataagcatatgtaataaaagtaatagcgatgtgtgtcatattatatatagtttccgtactcccctagtggggtgggtggattttattttcaggggaacttccaaccttataaacaattcaccaatacattttccatctatggggtaaaaatgcaataggttatagccatatagtttacgccagacctctaaggcatttggaataaaggtagaaaaaaagggcaacatttaatatttgaataaatatcataagggtgaagaaaggagagtcgtgggtacatattgagagaaaagtaattataaattggtatgactagaagagaatggcaatgagctttggcaaatgatccccattatagtgtagtttaaacgattgatgtacaagcccgaaaaggctggagaatatcagatctgctggttacagggtgtatctgactaccagtttcagggtacagctgaaataaatcagtgatcccagaaaagaagtttctttttacgtgcaaaacttctgagcaaagtgatctctgccagctggagctggggattcacagcctctatttttccatcaaaagaattaagttgactcccagatagagaataactatatattttttttcagatgtagcctcctgagtactcaaaaccatctccaggatatggaaaattcaccttatccaaacgtatatggctaaaattcctttgtaaggcactacctatttccctgtttcttgtatttgattagagataactattgagaaaacatggtttatgaaagaaatgggaaaatattttcccgttttgataagaatgtatttttaaaaaacaaatggaaacctaaagacacaaaaaaatatttgtaaaggggataataccctgagggaagggagccagaagtagagactagagatattaagaaaaactttaatgaatttatattttggctcagagctcacctactaagggagtaaacaggcaaagtcacaaaggtttataatccttacacttgccattggtcggggtaggtgattagatgtgaaaaaaaatgatgctttatttattctgggcatattaaactgaactgggtgatttaaatgaactgtaggaaattcaatgcaacagctaaaatgaatgactaaggagctagaagatcttaatctgtataaagctgaaagaacaaaatatgcacaatttagctctgtgctaatgaaaggaaagagataacactaaaaataactgaatggtgcaggcttcaaggcagcagaagagttctggcacaaatggatctatccagaaaaaaatgagacttaattacacaaaggaaaaactgttgactgtgaggaaaagtgtcccaagatgaaatgactgctgttgaatgggaaaccatcagagaggcagtgacgagagtgttatctcgacaactgaagcagctgaaatgagacacgttgccggaaaagccattacagactaaataccccctggtcctaaagagatagatgcacatcaacttaaggagaattgcagagcaggcacaccactagaacacggggcagtgagtcaggagtagggtctttatctcaatgccattaggtgtagtcttgctcaacctaatttatttctgcggcttggattgctttctgactattctgcttcagtggaatgtcgttgtgaccaattttgttgctactaaaatacttaagtaacaaaatccacttcttgataaagatttaatgtcatctaatccctaagagttaaggacattacaaagattatcagtgaatcaatgaatattggtagtcatcatcaaaaaacaataggttgagagtttcagtaaaactaatgaaaaccatatataagaacattataaatatgattacaatagatgcatctcttttagaaacaaggtaataaacactgtgcttccaagatgtatttaagaatgttgaaggaagtgaggcacactgacttgtgcctataatccccctgggaggctgaggtgggagggttacctgaggccaggagttagagatcagcctgggcaacaaagagagaccatatctttaaaagaattttgttttagttagccaggtgaagtggcacccacctgtaatcccagctattcaggaggattgcttgaacctaggggttcaagcctgggtgacagagaaataccgcatctctaaaaacaattttaaatttaaaaatagaaaaaagcatgctacactgggccccaagatctatgcttgcctccaatttttccccaatttttatgatttccctttgtgtaatgtgatatttgatgcataaaagaatatatgtaatggatatgtaaattacaaagctcaataataaaacaaacatatgtccatcccaataactgaaatattagcaacaactcacacctgaacctatgtgctcctacactagttcttcactcttttgtacccctccctccatttacccaggattaactaccatccagaatctggggattgtcatatcattgcctttgatttcttttgtttgctcatttgttttgtgttggttttttcgatttatcacacatgcatgtatgccaaaacaatattttcattaggtgttcctatgcttgagctttctggagtgttgtctaatacaagggtcagcacactaccgcccatgggctccccggctctggagtgagtgcacttccccaggctggagcgcagtggcgcgatctcggctcactgcaagctccgcctcccgggttcacgccattctcctgcctcagcctcccgagtagctgggactacaggcgcccgccaccacgccccgctaatttcttgtatttttagtagagacggggtttcaccgtgttagccaggatggtctcgatctgctgacctcatgatccgcccatctcggcctcccaaagtgctgggattacaggcgtgagccaccgcgcccggcctccctgacagtttttaaaaatgaagttttattagactcactcacacctattcactcatataataactatggctgctttgatgccacaacaacatagttaggtatttgcaatatgacctagaagcctgaaatatgtactatctggccctttaagaaaatgtttgtggacctctacattatgtttttatgattttctcatattcttacatgtgatcatagttaattatttatactgctatataatattccatggtatgaccataatacaattatttgctattatgaacactgtagctacgaatgtccttccctccctctctggcactggagacactcagtgtaaattgatttcctaaattaattctttaatcctttttgcgctgaatatagaagtcacaaagtcacacaaacattaaagaatatttggaaataagagtagagtacagaaaatgcaaggaaaaaaaaacaattctatctctcccccttagacaaccggtaatactaatgttatgcctttttcctcttgctgtgaaactccttatccattaacagctaaggaaggatcactgtcgcctcaccttcctttttcatcctgcctattatgaataatccataaatctcattttaatgatttcactagaaagcattaaatgtaaataatccgtgggggtggacataggaggtaatattagacgagcaaaaggaagaggcaagatttaaaagaccttattaagcttttaaaatgttttagcacatgtattctgttcttaatatttcacacacacaaaaaaaactgtctagaaaccacaggtgatttcataactttacttgtatctcttttttttttttctggagacggagttttgctcttgttgcccaggctggagtgcaatggcgccatctcagctcaccacaacctccgcctcctgggttcaagagattctcctgcctcagactccggagtagctggggttacaggcatgcaccaccacgcctggctaattttgtatttttagtagagatgggctttttccactttggtcaggctggtctcgaactcctgacctcaggtgatctgcctgcctcggcctcccaaagtgttgggatttacaggcgtgagccaccgcgcccagcttacttgtatctcttaatcccatcataaaggggcatatcctattactttaaaagccaacaattccctctcattttcattcaccatgagttactactactcctgaaaccttcacaaagtttcccagaaacaggacagcccactcctagcccatgggcctcttcccttcctcatttcttacccttttcttcctccctgctttttttcttgaaataaaatttccccaaaagctagtctgccactgcaagcacatcctcagataactggataaaggaagataatgtggcacagaggagtctggggatacttctagccaaatagtttttgtgccataataatctttatgacagtaggatcctgaaatgttacctagaacacttgtgcctagtcccaatttctggtgggataaaactgtatataagggaatcattacaggtgcttgcgtctgagacacttctggctatgattgagtctcctacacattatcaaaaaacgtgtaatgctttaataacaaaagtaaatgaaaatcctcaaaggagttaatatgctaatgtacatagtcactttataagagggtagtgtaagcaaattatcccacattaactcaatcagagtcccggtagaaactggaggattgatttctcaatctcggggtatgtgaggccagtttgctaaaggggttatcaacagagatatgctcagtgttaggaaattcaagaagggatgacggagagttaactgtagacctcaagggttaagaggaaggacgtttcctgaactagagagccagacccaatagaaatgcaagagagaactgtccagcagaagctctggtctaatgttagctgttcagagctaacctgtggaaatcccatggggccacatgaaaataaatactccacccttttcttatccactgtactcctcctgctgcagcctgtctcaactggaaactgtagggcaaaggaactctgatgccattcctaaagggcagtccccaggacacaaagcacagtggtaaagaatgaaaaatggatttgaaaggacaagagggaaagaatttatgcactaagcataacttttccctttcaagttaatctagtatgttgagttggtttgctctttaactaaacccccctgtttccaaagcctgaggataacatactacctactgagttggtaaacaaccttaaggcagcagtcctggagcctagacagagacattggatgagtagacgaatggaggtacacgaggtatacatggatggatgcatggatggataggtgaatggatggatgaagtcaatcacattagtattttacagacacacgttacacaacctgtatctgaacacgatgagtctctcttcctcctttgattatggaagttaagagcaagcactgaggtaaccaatattatatagatttctggagtaaaacaggtactcatcatgactatcaacgatttgaatttggggatgatgtcaattattcaaagaacctgaaaaaagtagtgaagttgcttatctgaggccccagaacttccttcattttactctggctttcaacgttggatacacattaaaattatctaggaaacttttcaaactgagatgctcggattacagaccacttaagtcagactctgtggaaatagaacgcagatatcactgtttgtaaacactccaccaatgtgtagcaaaatgcgaaaactactgatctttccactctctttaagatctaccattatgagccccaaaatcattctggttctcttggtaatttacattttttaaaggaaactctaagatgccttgctgataatattatatatgaaaagggttatcgaatttatcgggtttggggttgggggaaataatacttatcaaaggagtaaaaatatgagcagttcataaaataacctgtgatagtccagattacttgcatattttcccttgcatttcagagtccttatcagtattcaaaggactgtagagcttttagaaatgcttcagtgaggaacactttatactctgtccctgataaatgaaagtgtttatttcctctcagataagtcagtaacaagcaagtattttctagcaactggactatacccacctattcatttcccaaggctcattgggcatcactaggaatacaacaggttttagttactaccaaccccagttactgtagaattaggcaattatataagagtttaaaaaatcagtaaggatgtttttattttaaactacttggataattgaaaagtaggtagacaacatttattttttgtctttatttgccaaacgactgtattagatttaaaaccagaaaacaagcccctatgtagaatatagattctcaccagttcatagatcaagtaataagacatttcctagggtgtttaattgtttgatactaagagcaataaattataggaaaataatttgtaataattggttaagtaattaaccacaattaagaaaagatgatggaatccctgaggatatccgacaatactgacaacattataaactttaagagaaaaaaaatagttgttgcagagcaagaaaagtcatcatgtgcctagcacaaatagaggtctaattataggggattttacgtttttcataatgtctacaatgagcatatactacatttataatcacgaacagtccattagcaggtatcatatatctgagttgggaaataccctgtcacttcgctaatacttctttctttttgttctaatagtgtattcaccaaataatcttctaaatatatatgtgtatatatatatatttgagatatatatgtatatatatttgagatatatatgtatatatatgtgtatatacgtgtatatatatatttgagatatatatatgcaggaagaagtgagtgacattctaagaaacactaatgaccaaaaaaccacataatatcttttcttagtggtgttccttccttatattggccaaccaccttgcaataaaaaatgatgatgtagacagaaaggaaaagttagagctacctattctttttcctttccttttagtccctccttacacgtcagtaagccaaagggcatcttcttgataaactgtacatttatgaagaaaggaaataaaaaccattaagttcattttatgcagcatttccactattctggtaagtaaagaaagcatgtgtgtggatgatgtatgaaatacaaattgtgtaatttctatgactctccatataagttaaatattctcatatatccatctaaaaatagcactgacttcagtaaagtttcaggaaacaaaatcaatatacaaaaatcagtaacatttctacataccagtaattttcaagctaagcaccaaatcaagtatgcaatcccatttataatagccataaaaaataaaagaggtgaatgatctctatgagaagacttacagaacactactaaaataaatcacagatgacacaaacaaatagaaaaactttccatactcatggattagaagaatcaatatcattaaaatggccatactacccaaagcaatctacgaattaaatgttattcctatcaaaccactaacatcatttttcacagaactggaaaaaagctatactaaaattcatatagaaccaaaaaggagcccaaaagtaatcctaaggaaaaagaacaaagccagaggcagcacattacccaacttcaaactatactataaggctacagcaaccgaatcagcatggtataacgtttcagttacatacaatgaataagttctggagatctaatgcacagcatagggactatagtcagtaatactgtattgtatacttgaaatttgctgagagtaaattgtaagttttcttaccacagacacaaaataactatgtgaagagatggatatgttaattagcttaactgtagtaatcagttcactgcgtatatgcacatcaaaacatcccattatacatcttaaatataggcaatttttataacatttaaataagagcaaaaacaaaaacaaaaacagcatggtactggcacaaaaacagacacataaaccaatggaacaaagtagagaacccagaaataaagccacacacctgcagccatatgattttcaacaaagttgacaaaaataagcaatgggaaaggactccctgttcaataaatggactggctagccatatgtggaagaatgaaactggatccctaattttcgacatgtataaaaattaacccaagatgattaaagatttaaatgtaagacctcaaactagaagaattgtagaagaaaacctaagaaacatcattctggacattggggttaggaaagcatttatgactaaatcctcaaaagcaattggagcaaaaccaaaaaattgacaagcgagacctaattaaactaaaaagcttctgcacagcaaaagaaactatcaacagagtaacagacaacctacggaacaggagaaaatcattacaaactacatatcacacaaaggttcaatatctagaatttacaaggaacttaaaaaactgaacaagcaaaatacaacgccatcaaaaaacaggcaaagggcatgaacagacacctctcaaaagaagacatacaagtagcctacaagcatatgaaaaaatgctgaataacattaattgtcagagaaatgcaaatcaaaaccacaatgagataccatcgcacaccagtcagaaaggccattattaaaaactcaaaaaacaacaaatgctggtgaagccgcagagaaaagggaatgcttatacactgttggtgggaatgtaaattagttcagccactgtggaaggcagtttggagatttcccaaagaatttaagacagaactaccattcaatccagcaatcccattactgaatatatatccaaaataaataaaattgttttaacataaagacacatgcattcacgtgttcatcacagcactattcacaatagcaaagacatggaattaacctagatacacatcattggtggactggataaagaaaatctaaatataccccatggaatactatgcagccataaaacagaatgaaatcatgtccttcgtagcaacacagatgcagctgtgatggaggccattatcctaggcgaattcatgcagcaacggaacgccaaataccacatgttctcacttgtaagtgggagctatatattgggtactcatggacataaaggtgaaaacgatagacactagggattactagaaggggaaggagggagggggataagggttgaaaaactgactattgggtactatactcagtacctgggtgacaggatcattcgtaccccaaacccctggaattcacttgcatgctccctcccataaggagttgaaaactggtctaggtaaatgaggcaaccctgtcacgagtcccgggaaggggtcagggaaataggctgcttcgatatcatacaactctctttttaaaaggtccttccaatatttcttccaacttgaagtccagctttacaacaagtttctggactctcttctttcctactctgcaggttatcagaaaataaaacaaacaaaaccgcaaactacaaaataacaaaaacacccaagcaatgtgattagttaagacattattaaagtgtgggtgtttccagagacgtttcccctttacaaaccatcctattctcttaccttttgagaagggagtgtgtgcgtgtctacgtgtacataagagagacagagaaagtgaaagagagggagatttggtagataaagactcaatagacttaggaatttcctatgtcgttatttgaatttgagagattactgagtgtaagaaaagataatccattttggctggagcagtggctcatgcctgtaatcccagcaatttgggaggccgaggcgggtggatcacctgaggtcaggagtttgagaccagcctggccaacatggtgaaaccccatctctactaaaaatacaaaaattagccaggtgtggcggtgtgtgcctataatcccagctagttgggaggctgaggcagaagaatcgcttcaatccaggaggcagaggctgcagtgagccgagatggcaccactgcactccagcctgggtgacagagtgagactctgtctcaaaaaacaaaaaaagaaaaaaaaagagaatccattttaacttgaatcttgaaattttctgtaaagtagcagaggtaaattgccatggaaatcataggaaaggaaatataagcccaacacggtaatagactctgcaatgaaatatatttatggtgctataataatagtgtacatactgtttatatgttttcaatttttagaataaatctttgacaaaacacgagacctaatcatagttagagaacacagaaggaatgcaactcaacataaaattaaaagtagactttacagaatttgggagaagaaattcagtaggagaagtgaagaaacatggaggaccactaaaatccccattttatcatgtgaagggttaagacatacttttgacactgttttgaagaaaaaaattaacatttaaggtcttcatgtaaaagaaaaattagttaatagaacaaatacatggggtagatataaatgagataatttttcatctctcataagagagactgtagaccatgaaaaaatgagaaaatcaagaattagagatataaacatgttattacagatttgtcacgcattagaaaaagagaatgactcaaatatctgcctctgaggagtgagaaatgagagaggaatgcagcatatttaaataaaagaacttatgaagtaaaaattacttgaatcatgtacagataatttgattaaaaattgaaaacattgattcaaacaaatttatattcattaataagcattgtacactttttaaaattccaataagaaaaaatgagagacttaaaattaggtaggaatgcatttcccagaggttaaaaatttatattttaatatatatgcatatataagcgggatcataatacagcattatatgtatacatactgtgtattacagtctgctttattttttcatgtatgtatttggattacctttaatatcaatgcaatcacctgtaaaattttattttaaatttcccttctttagagatatatcattttttagtagcctcctactgatgaatactggtgttgtttccatttttcactgtaataacaattaaacaataaatataggtacaactcagtctttgcacatagatgtaagcatttcttcgataatttccctggaaatgcaattgcttagtcaagtgtaagcacgctttctcttgattggtattgcaaactgctctcatgaaataaattgattcagtcttctgtcagaagcatacaaagtatacaaggaaaagttatttttattttcattatttggttacaaatgagatcgaacattttttcatatacctttggatgtgttttattttctttttgtccaaatatatggggtacatgtgtaattttgttacatgcatagattgtgtagtggtcaagttagggcttttagagcgtccctcacccaaatatatcatacacattaatttctcattatccactccactccaaccccctcaccctactaagtttccattgtctatcattccactctctgtgtacatgtgtacacattttttagcacacaattatgggtgaacatgcaatatttgactttctgtgtctggttcatttcacttaaaataatgacctccaggtctaacactttcttcctgtatgcttaaaattaggcaatgcatttatttttctgaattgatttgtaagattcaatttcagtttactggtttttaatgtacagattttaaaaattatctatgtgttttccattttaaattttgggtttttaaaatcatttctacatagttctctaccatcgcctcattgtagaaatattcacctatcgttcttcctgttctttgggcttcttaagcttaattatgattgaatatttgttcaaggtgaaatttaattcactgcattgtgtaaagcagggttttgccttttaacatgattatcaaaaccatttctttcatagtccatctctatccactgatttgaaattccatttttattatatacacttgagcatattttgggattttctcttttgtttcactaatctgtttgtatagacttttagtagattttttttttttttttatacagagtcttgctctgttgcccaggctggagtgcagtggcgaaatctcagctcactgcaacctctgcctccctggatcaagcgattctcctgccgcagcctcccgagtagctgggattacaggcgcctgccatcatgcccggctaatttttgtatttttaagtagaggctgggtttcacgatgttggttaggctggtctcgaactcctgacctcaggtgatccacccgcctcggcctcgcaaagtgctgggattacaggcgtgagacaccgcacccagccagtagaagttttattaaacactctaatagctacatgggcaaatgacctttcatttaaggttttcaacattttctattaatcctcatctatattgctgccagataaactttagagtaattcttgtcacatccaatgtcttcctgccaccccaatttaaattttatgtgtttctatcagattttagcttaatttgtagtaaattatatgtctaaaatattaatattcccaccaagaaatataaaattatatctgtccatggatgcaaatattctgttatttttccagtaaaggcttgtatatcaccaaatttcatgctaaataaattcacagtaatttcacattttgaacttctgtggaaaatgatagctttgattttcaataggttgttaaaagagaaattagcatttagaaaaattacatttaattaatatttaattatttctaggttttttcttttcttaatgagctttgggactaatttttcccattagttataatagttgtcattgttgatttacttagtaccaagttgacaatatcatctattaatatgaataatttgacttttttccccaatacttatacttcctgtttcttttacttggcttctttcactgactagaatatgcaaaatagcatttaaaaagagcagttttggtagtcattctagttatatttctaattttaatgaggataccttcaatatttcaacattgatcacagagttggctcttgttttgagatagacaatatttttcatgcttataaactatcatctattcttacattgctaaaagttttgtttctactcctaaattagggacagattcttttcatttatcaatactttttcataactaaaaagtattgtatattttttccttctgatctttacctacaatgaaggatgtaaatagattctcttatagtaggcatatatgttttcctgaaataaatccaatttggcatgataacttcttctcttattggctaaatctgctatgttttataagatttgaacgtctgtattcctgagattggttgatagttttcaatgtgtatgctatttttttgaagtctcataatcaagattataagggctttagaacatgaacatagaggtttaaatactattttcatggtttggaattttgtaaacagataattcatacttagttgtttgaaagcatttctcaatatagtatttttgaagttatttcttgtactgctttttaaaggtttcttacagaatcaaatgtttagttctcttattttccctttaatctcaaatataaaaaaattaaggctattaattttctttgattacagctttgttcttattccagaagttttcatgtgtattttccttattcattaatttttaaatggcctactttttttttggttcaaggaaagaacactactttttctctcctgttacaaaaacaatgtatgtttaccataaaaagatacaacaataactattaagaaaagtacagataactcattttttcattaagcagcaccactgctaacatcctgttgtctactctgagtgtttttctgtatatctgtctataaaaatctaacgtaaattcaatgtccgattcctgtattatctaaaaattatatcatatgatctactaatcatcttttcctatttgttttaaattgcttgctggttttgttacattacatttttttctagacattttataacaaaacagatatatcaaattaatcatattcaatgatgtgttgttgcaaacatatgtttatgaagtccctgcttcgttgacattttttttcttgttcatatggctggattttctttgaatttacgggcttttgtatgggagctgctatattgtttacaagttcaatggcttgcaacctttcctgtgcattatagtcacctggggagcttttaaacagcccagtgactaggttgccacctaaaccaattaaattagaaacttcccaggtgggacctaggcatctgtaagttttaaagactctcgtgatgttctaaatatcagcaaaggcagaggaccattgagcttgttagaatatttgggaaagggtgtttctaagattaaaacttaaggcttatgtatttcgtaaacgcagctgctttaacaaattagtaaacaagctaatcctagtatctctaaaaaacactagtttaattttgcctggagctgcagttctcaatatattgtccagcatatcctccatgcagggaaaccactgtatacaccaatacttatgagggaggatgatttttcaactgcaaatctttaattgccttttagaaaatccatccagttttccttaagcaagttttagaaagcacatacacgagcaattacaaatctggccttcagcctaactcaagaattaaaaaaataaaatctcaaagtgaagttgtattaattctttttttctccttacttttatttcataaaaatagacatctttatcataaaactggcttcttgacatcatttggggccactttccctctgaaagacaattctaattgcatttacttgttctcagaatcatacatttttttaaaaatgaaaatagtttgtacacgagttgccaaagaatggtctaattcagtgtcaggacaaagatggtctaattttgcattatttagtcatctaattaaaaacaaaactagtaataatttagccataaagctgttcattgaagaataaaagcaattgttaattaacttttcattgaggaaagtcatacatttttcatgttatcataacatttcaaaatgccctgggaaattacaaaattaaggtaatgtaaattattgatatattataactctaacaatgaaacattttacccaggcctctaatgaggattctcagttaaggggaggagcagaggaatgcataaacacatgggaggtggggtggagcggaaacccagcttccaggaagatgttttaggagaaaacagattcctaagctatttgaggtacaacagaccgaaggcaatgtgcagtgcaatttatttccctaaacttatctgttataaaactgaatccttaagctggttgtacaaagtcacacaactagtcagttaatgttctacaaatagctctttcagagatttttctactagacttgtcaccttatttaaaccttgaaaccccactcaaaattgacagtgagagaaacagacacacacacacacacacacacacacacacacacaccagggacggagggagagaaagtgtattaatagctaaaacccctcttggccttgggaaagaaactctctaccctctgttaataagaagtgagagagctgcctcctctttgaataaatcaggttctttagacaatgtagagttaagggctttactcatcaccctgttctctggatgccatgtaagctcaccagattcttgtgaaactacagagaatggattagacagtccaaaacataacagattgtacttgtgtttgctctggtaagtggagctttagtttgatgtagagaaataagaggaaccggcatttctttcacctggacattatgaaagagaggtatctgaatcatccaattaagtgagcaggaaatctggaatattgtaggtgttttacatgctcattctttctttctacctgcttaattgtatctgtgctatttctgttaaatgcatctgcggtgaactttgcagttgctaaggagagcgtttgccaattccatatgcctagtctaaggtaggctgaagctaatctgtcattctggagaagcaagagaagctaaggttttcataatatttagttgataagggatgagaactttagatacatgttatctcttactttgctatttttccaaaaatgtatttgaaacactgttaagcagagcaataatatttatgcagcattttacatttttaaagtcctttaaatattacatcatgcatcaaaaattatcgataccaagatgtgattgtctcaattttagagacgataaaattaaaaataagaggttctcaaaatgtcattattttataataactgaacaaaagttttacctcaacatttaacatcaaaaacattttcatttttattagatcatgatgttctgtttgctcgtcacataaaatattttaaagagatgtttggggtttaaacagattaagtatttctatagtgccttgaattaacaaataaaagtaaataatactaaaactacacccatctattgtcttgctatgaaacctagaggtaaagtgtatgtgaagtaaaacagtatttttgaagttgtaatgtcttaccattgcttcaattaaatcgttacatacacacacacacacacacacacacacacacacacacacacgcacacataatatattagatgatagatagattagataggtaggtaggtaggtagatagatagatagatagatagatagatagatagatagatagatagatagacagacagacagacagacagacagataggcatttgtgatccccactgaaaaaaactggcaagcttgcctaaaagtgaggagaattattaagaaatagtaaactacccaaggacattctgttcttttccttacacataaatatgaacgatggtgctcccctttggttccaactttctgtgtttcatcccctatcatgccaccattgtgttagtgtttcccatttctcctttacattcaaagtgttgcctgtcccatttaatattttaatctgaagaaatccttgggatgggaaacacaatggtaaagaatgaagaatcgctttttaaaaatactgatgattacaatgtattcttaacaagctttggatgaatttgtattagtcgcccaaacagttctaaaaaaaatcagcataacagcaaatttgacaacaatcaaaaactcatcctttctgaatatgtccctgaaagaaaagctcagcactgtatgcaactccatcatatggagcccagaacatctctttgtggatatgtgactaaaggcaaaataaacatccagtgtaaaggtgcagaggcaaaaaaaaaaaaaaaaatagagtggtctattggaggaaatacagatggactggtattgctagtagaacggtggtgaatgaagctagaactatagccatgaactagatttttagaaaccagtatcctatacttgggggttagatttcattatgtagacagtagttgtggcaacctatgggattaagtagggtccaaaaacaaatatgtagtagtagtagtagtagcagcagcagcagtagtaacagcaatgacaacatctaggatctattgagcacttaaaacaggccaaatactgttttaagctctttacttgtatcagctatttaattctcatagaaataagtatcattttatcatcattttacaggtgagtgatgaagtatcttgctacacattatggaggtagtaagtagcaaagctggaattcaaacagaaaccagtgtgcctttacactgcaccaccctgtatgcttagggagatcactctgttggcacattgcagggggagaaggacattggagactgtattcaccacggccatatattgtgtgatggtatatttcttggaaagcacaattcgggaacaccatagcagagaaggcaaatattatcagccttctttacaggttagaacatagactcagagtgtttaaattaattggccttacccttctgaatcttcatacactgcactttctacccatcagaattacttattcctatttcctaagatcagtcattccagaaaaaatgaactttcttctttttatgaattcagaaggaccggagacaggtaggcaagacgcatgaacacaaaagtgtcttaaaatctcagagatacattcatttgtgcactttcacttattcattcattcagtaatcatttatagagtcttttatgaaccatgtgctataagctaggtcccgggagtaaaaggcgggagtaagctgacaattaagttttcttttgtccattgaattttgtccaattcgcaggtggtacttggttggttgaacctcctaaagttaccttctagctcatgcccccaactatttgccactttacaaaaacgtcacacacaccataaactgagaaaatcatcagtccagggaggctcattccttctgcgatgaagaattcctatattgtcgcaatattcagctgacaagccatggggtaaaactactgtgagcatttcaacttctgattataccccaccattttttctgatggaatacagagagtggccaaaccagcagccttccttcaggccacatttccccagcccagaagttcctaaaatcttgtggaggcgattcagctttatatttgacagttatttatatttctggccctacagactctgtccgagcaaaagcttttctagacatataattttaaggggaaaatatcaatatttgaagaaaacaagtgtgctggaatgtccctctaccttatgattcatttgttattcctagggtgttctgcagcaggttaagtgggctattgaacaaagaaaaccccaggaattctgacatattctattaccttaaactgatcgaaaatcagcttttcttctgttgagatgaattacttgacagtcagtagaaaaattcttcccatgggtttctcctttctgaaacctttcccacccccagtcctcagaaatatactttggtgagtttcctctatcccaaagcattattcatataatccaagaaaaactgaaagagacttgaggactaatttgcaatgatctgaggtacctgaaatattttattcattttatttttatatttctttgaaataaatacacttactatcctaagggtaactctgatattaaaaagactcacatttattacatatataccagagcctatatccccaaatagaattatttatgagaaaccttaacgcaaataaagatactaagccctcggggcctcttgtgcttttatatttgacatctcctctttttaaatattcatgtagaatagccttaagtagaaacttgaagatgtgctagtataaaacattttcctgagccactttattgttgatggggtgttttctcaatctggatctcagtaagtctttcccttaaatgaaaaagggctatttctcaaaccatgtatgaatgccagcatttgttcagcttctttttttgtttgttttttttttttgagactcagtctcactctgtcgcccaggctggagtgcagtggcacaatcgcggttcactgcaacctctgcctcctgggttcaagcgattctcccgcctcagctccccgagtagctgggattacaagcatgtaccactgcacccggctaatttttgtatttttagtacagatgggatttcaccgcgttggtcaggctggtcttgaactcctgacctcatgatccgcccgcctctgcttcccaaagtgctgggattacaggcctgagccactgtgcccagccttgttcagctcctttagcttactttagagcagtcacaggttgccacttttccagcatcagggacaaagttcagatcaattttataacacgtcgattctaaaaatcacagtctcgtgggaggtggaatatctgtcacaactcataacatatttcctactgcttcatgttccatatattagaaacccattcaccactaatttccccaaatttacaagttaagagtttaaattatagttttataagtgaatttatctactttatttttcaggtcatggattctagctctcatatgaagtaaggtcttaatgctttttatttctttaccttatgttaaatttcagattgatgagctttctaataatattgaaagttcacattactaccttagtagagcttccaaattcaaattgaaatttcactgggctgggtgcggtggctcacacctgtaatcacagcattttggaaggccaagacgggcagatcacttgaggtcaggagttcaagaccagcctggccaacatggtgaagccccgtctctactaaaaatacaaaaaatagttgggtggcttggtgcatgcctgtaatcccagctactcgggaggctgaggcaggagaatcacttgaacccaggagatggaggttgtagtgagcagagatcgcgtcactgcactccagcctgggtgacagagcaagactccaccaaaaaaaaaaaaaaaaaagaagaagaaaagaaatttaagcgaagatgtgagtaactgtatcagaccagactcatttttatatgtaaaagatgaaatggcgttttctactcttaataaaggcaaagatgaactaatacataatgcaaaatgagcactggaagagatatacaagatgggtaagagcaaaactatcaatttttgtatttttcattcattcagcaaataattaccaagcaagtcatacatacgtaaaatagtctttatattttttgtcccatctctatgatagtgatgaaagtgaatgattctttaaaaaaatgataaatattaaatatcggctagatacaaaatattatcattggtgtatataaccagaatttaagttgaatcattggcatcaaagattttaaatagttcggaaaattaaaaaatacattgctagtccccacttacaaggagcttgagaagagaaaataaaaataccaacaaatcaatacagaaatattcactatagatcatgaaactcaatgacctgtaataaagtttaagaaaaacaattttatattgccttgatagaatagcccaaatcatcaaagcagatggaattttcaaagacagtatgctatcatgagaaagacatgtgcggaaactaggaagaagcttgtattctgaatgtgttaccaagaggttacaatgaatgtaataaaacatctttttgtggtaagaaatatggaaagacagtagctgttctactgcattaatctccttccaggttaacaggtgcagcagcagttggcttcagaaactcttgttaatgcgttcctcagactgtcccatctgcttcttattgtttgctccatacaaaggcatgttaatatgtctacctacatatcatcattgtttcattttattatttgctaactgaactgtgccaacatgatagaaaagaatcaagcttactataattttaagatactaagacacttactagtaaaaacaatgtttatcgaatttaagacctttgtggactcataacagagaactagttctgtgcaacaggttcctttcacctcaagccattcaatcaacattttaaaaattccaatacgattgctccaaggacctatgagagatactttggattcaaggacctcagagtcgagtggaaactctttctttaaatagaatgtgacccagaagcccaatatgaaacagatgaagagtgagctattcagctaaaggaatgctgatggtggtagtggtggtggtgggcatccactgtcttctcaccctacacatggcccttgaaacactactaaaacccactaaggctccagtgagactattgtaaaattcccatatattctccagttcctagtttgtccaccaaacctatccacagcttttctttgtttttaacttttaagttcaggggtacatgtgcatgtgtgttatataggtaaacttatgtcatggggatttgttgtacagattattttgtcatccagatataagcctactaaccatcagttatttttttttaatcctctccctcctcccaccctccaccctccaacaggtcccaatgtatgttattcccctctaagtgtccatgtgttttcatcatttagctcccacctgcaagtgagaagacacagtatttgattttctgttactgtattagtttgctaaggataatggcctccaactccatccatgttcctgcaaagtacatggtctcattctttcttatggctacgcagtataccatggtgtatatgtaccacatttgctttatccagtctatcattggtgggcatttaggttgattccacgtctttgctattgtgaatagtgctgcaatgaacatacgtgtgcatgtgcctttgtaatagaacgatttatattcctttgggtataaatgcagtaatgatattgctgggttgatggtatttctgtctgtaggtctttgaggaattgccacactgtcttccacaatggttgaactaatgtacagtcccaccaacaatgtatacgtgctcctttttccccacaaccgtgctagcatctactattttttgactttttattaatagccgtcctgactggtgtgagatggtatttcattgtggttttgatttgcatttctctaatgattagtgatgttgagcttttttcatatgcttgttggccgcatgtatgtcttcttttgagaagtgtctgttcatgccctttgcccacttttttagtagggtttttttttctcatagatttgtttaagttccttataaatgctggattttagacctttgtcggatgcatagtttgcaaacattttcttccattctgtagtttgtctgctcactctgttgatagtttcctttgctgtgcagaaactatttagtttaattagatgccatttttcaatttttgcttttgttgcaattgcttttggcatctttgtcatgaaacctttgtctgttcctatgtcctaaatggtattgcccgggttgtcttccagggtttttatagtttgaggttttatatttaagtctttaatctatcttgagttaatctttgtacatggtgtaaggaaggggtccagtttctatcttctgcatgtggctagccagttatcccagcaccacttattgaataggtagtcctttccccattgcttgtttttgtcagctttgttgaagatcagatggttgctaggtgtgcagtcttatttcttggttctctgttttgttccattgatccatgtgtctgttcttgtaccagtatcatgctgttttggccactgtagccctgtagtatagtttgaagtcaggtaatgtgatgcatccagcttttctctttttgcttagtattgccttggctacttgggctcttttttttggttccatgtgaactttgaaatagtttcttctagttctctgaagaatctcaatggtagtttaataggaatagcattgactctaataaattgcttaggattgccttggctacttgggctcttttattggttccatatgaactttaaaatagtttcttctagttctctgaagaatctcaatggtagtttaataggaatagcattgaatctaataaattgcgttgagcagtgtggccattttaatgatattgattcttcctatccatgaacatggaatgtttttccatttgtttctgtcatctctgatttctttgaggagtgtttggtagttctccacgtagagatctttcacccctctagttagctgtattcctaggtattttattctttctatggcagttgtgaatgtgattgcattactgatttctccctgttgcactgcatgcaacagatgcaatggaacagatttctctctgttgttggtgtataggaatgctagtgattttggcacattggttttgtatcctgagactttgctgaagttgtttatcagcacaagaagcttttgggctgagaccatggggttttctagatatagcatcatgttgtctgcaaacagagatagtttgacttcctctcttcctagttggaggcgctttatttctttctcttgcctgatttccctggtcaggacttctaatactatgttaaataggaatggtaagagagggcatccttgtcttgtgctggttttccatgggaacacagcattccttaaatagacatgaagcccctgcccacaccccagtgaaaaacaactcactacttccagattaagctttttatatttttggccatctctcactgttacaaagtttgtttgtttaaatatttagtggacaaagggctctctttcctttcttctcatcataataagaatatgcttcattgcatttccactgattagctgaatatttgaaaacagctaatacgtccctaaaattataagttgctttctagacaggctccagtttttcagtgtctcatttaaattatgttccccagagctgaacagtacagatttggtctgatgaacttacttttagtgtcaacaaagagggtgttctgggcaccatttcaattactatacttatttgtttttcttgtatctctatcataatgttaaagtcatcgtaaactcttgtttttttatttaatacttttgggtggagagaggggaatgctaacttaagaaattatattttccctattcaattttattttgatgtattaagcaactatttcagtgcctaatatgtgccaggcatgtgataaacagcaggatgcaaagtatacatagtctacatctacatggtgtatacatatagtcaaagaaatattataacagttaacatgtattggtaacttaagacatatgtatagaggaatctgaggcttggtttgtggtcaagatggtatatatataatccttggtttgtttgcttcttgagacaaatctagaaacaactaggccaaagtaaacactatcaactattataatagtcatgactcctttgagtatttattctttcttctggaactctgacagatattgtgatttaagggcgtagggataggaaaggaaaaaaatgaaagcaaagagacagtgagaacactttttagagccagggcacagcctaagatgaagaacaaatgaaagatctacatcagcagccaaaggtaaaaataagcacttcagaaagaaaactgattttccacagaagaaaaaatatggcagacataatgtctgatggcataggctccagatggaataagaaatacacagctgcagagtaaggctatcttcagttaatcgagagaagcctgatcatcagaagcattagccaatgtctgtaaacatataataataaaataaatgcagaaatcactataaatctttgtgttaattttgttttataaaaataattcaagaactgttattttggaaccattatatgtatatagtaaggtaattaccatataagcaattatactaatgtcattagaaacatagattttcagcgtaagagagaagagactgcagttaaaatcaaatatgttcgttcctaattcttgatccaagtggtgatctgagtggtagctatctgtgtttatggtatatggttatgttatgcttcaataacaaagtgtattaaaaatagaagaaaatgcaataaaagttttaaaaagcaaagggcaagaataaagataaatcgtttcttcaataaacagtgcttatcaatcactattgcacattttatttcacttaatttctcagaaaaaccttatttctattgaaaatctctgtatcttcaggcactggaaagactcccaccaatttaactgtaactcggatgttgatttcctaacacaagttcctcccattatttaatttacctaaggactatcagttaccttaatggaaaacccttccacttattatatctctaagttatctaacaatcatgtctcttaagaaaatatatatttttatctcaagtaatctcaagttaagattactacctttaactaaaatgtttatccattcaattaaaatttattaaagtcagctttgcaaatggtatttcttatttttcttcttcctttcatatgtgtacaaaatattaattcaacccagaagtgtttttcctccctaccagaaaggtaatcttattggttaatttattacctcattcacttaacttctacatgttacccagataaactattgtaaccagaacttacattattacgattgcaatatacattattaccaacctgctatttaggagaaaaaacacttcttagatatcataaatgcagctttaacatgcagaactgctttaaaacaggcatacaggaattttttggggggggatgaggggtgtgttatttttaatatgtctaaaggtaatacatttaatgaactatacaatatttataataagttattacaaatatgttcattttatgaatttttattttttcttaattatgaagtttgtaagtatattaggaaggtaataacttcacagcaatgtggcagacacagttgaatgtaacgtactcattaattttcaaaacaatcctatgagatatatactcttaagattccttttgtaaatgaatagactgaggcacaaagaaggtaaataatttgcctgagagcattcagtgcgcaaagtacaaggcacctaatttgaatttggcttcagaatccaactcttaatagctacattctgatgaccctagatccagggactcttctcatccaattccggttttgttgtgttttatgtaaaacacaccactgtgggttatcagattccaattttgttcattgtcttgaggattttatcatttacctgtaaactaaactgaattctgccatctcacccattttgccactcttactaaatactcaattgtttagttttccttcaatatcgggctacatctctccaaattgatgtttataattttttgccttccctcttgacttgacatcactgagaattaaaatctgactgcccaaatccttactgggactcctacaacctactgattctactgggacaacctacaaggttgtcttgtagctgtctttctcccccaggatttgaaaaagccttgcacactgaagcccaagaacttgatataaacttcaaaagacttaccaccacaacaaatcacgtataggcaaccttcatgcctggagctcctgctacaagagccattcagaaagtccactggaactccagcatcatccgtgttctgttccaggaaataactatgactgtgaaattaatgtttatgccatcaccacattcaaaccataaaccagaaaatccatcagattaccactctaccatctgaagatgcttagaattcaatgtctagaaaacttcttaactgcctgccctctagactcaacaaataggatttatattcttctccaacaagtttttgtttttatgtttgtttccatagaggtgcctctcattaaatgcctgatcacgtgcatcatccagcaactatgctctactagcaagtctcaaccgatgatttagctagtccttagtaaacaaaaggcaatcgaatgacaaatggacttacactgttcagaaggatgaataatgtgtcttctttacttgaacaggagtgaggctccaccaagacgctccccttgaccaaactttagctaggctcctctgagccctcttctcagctaggccataaccttggcctgcacagacctgaacaaaaaacactaacatagcttctaacaggtcaaagccacctctctaggataactctagccccacttaaggtgcatttctgagaaaactcaaagctgccaaaataatttaccctttgttccagtcaaaacccgaagacagtgagaaggcaggagcctaaccttaagtgccatttagcaaacgtagaggtttcccagggaacaatcccacctttccactttttgtaatttgttacttccctgactttaatgagccaccactcaaactcattctctcattctccctttaaaactcccagtcacctctacacaaatcaaagttcagttcagttcatgctgaactcttctctattataatagtgtattactgattaaaatctccccttactaattaaactgacgtccacttttgcttatctttggataactggttatttagttggtttagtttcagtttgtgaatgtcatgtggtctcaaaaggtcacatcatatagataaaaccgtgcacgccaacatcaatgaacatgtgaagaaggtaaacatgattattttattgcaccatttgtaaaaaaaaaaaaaaaaaaaaaaggtcaatttaaacgaagtactgcatgattacattgaacgtatttacgtatttgttgaatagtatttttcccttgtaaaattgtatatgttaattatacaaatgttggaatctacagaccatggaagcataaaatatatattgcctcccattctgagaaaatcctattgaaagataagttatgtcatcacagtttttctgtttttgtttcgttttggtatggcttggtttctggcttttgttgttattattttgtctatataggcaagtattcatttatttcctgcattagtcaagggtctctaaggaaatatttgattttatcaacagctgaagtaggaaagagtgcctggaatataatatccacttagaagttttttatggtatggttgattcacccattctatttaacctcagcattcaattactctcactgctatttttttttaaacctgaatcatacattttacatttaatatacactcattgcaaatacatttaaaaattctaataaggcagagcctttagaagaatgcttgactcagaaactcaataaatctttgttaactattgaaggaaattttaattaaataattaatattcataatcccactcaacaaaattactgatttttattaatagttttttcaatcacctgtatattttaattagcatactgtaaagaaagtaatcatttttcctttttaaaataaaaaacactatgttatactgactttatcactgagataatctcaagcagttattatgagctgcttttgagctatttgaaggtacagttttactgctatgtaatttccaggcctatgtacatctaggcataagattttctcagctgttaaagctcgtctcgttgccatttgtcccctcttaatgatagcaagaactaagtcatcccagttttgcacatattatacttgcgttaagttctttttccagttataagaacacaactttaatttcttatggataatttcatctgaacaacacattttagaccgaaacttcagtttccttaataatttgtacttttgattgtgggaaaatgacaacagcatacaataatagaatattatacttttctagctggggaaggctgatgacacaaaagcataggactacaaaatggcaaaaaacatgattatagtgtatacatgagtttttttgcaaagatctgaatagagaaaagcagtaaaatagtcttcacaacatatattgaaaaatgctaaaaatacaataacttgcaccattgcagctagtactatattcacattataaaaggccatttaatgtatccaagacaacattggcagacacattaaggttatgcttttgagttctattgcttttctgtacttctgttttatttgatttgaaaatatgatttgttgttgtagatctatatgccctttcaccataaagagtgtgccctttgttttatattcgtgcttctataggtaaattttaataaaaataattttaatcagcattggttgagcatagggctttttatttctttaaactggcctgtttattactcaggtttgagtagcactacactataccaagcatgaagcaaaatgtcttaacactaggggaagctgagcttggttctttgtagaaaaactctatccaggagacatggggtagattaatacagacattcacacacacctccacacatatgggaaggttgaagaatttgtaacatcatcgttttattaaaacaaaatatgtctcaccacattgttgggtacatgttactgatctggcttaataatatataggatttaacttcctgtacttgatatgcttggaggcaatattactgcagtacaagccagggcatcagtttcactatgcttttgtcagcatagaaagtagcactagaggacaaaatgaatttgaaccaatgaagctttcatacaataccctgaagggtactagtgtaagacaggggcaagaaagaaacagtgatgatgtgagatgtgacccgataactgtccttcatggatctacacaacctctggaaatgccttctgcctgcaagaagcgtcaggagccctagaacatatgctaatatatataattaaggaggccaaagacaatcataccactctattcaacgaaatttatatattcacatacatacacacatatacacgcatgccacatatacagaaatttatgcatacatgtgtattgtagtttgagtttcataataaaactcaaaagtgaagacagttcacatgcacacgaattattagacacaaaaattggaaggaggtaaaggataataaagtgttataataacaggctgaaagaactatgattctgtcttctttatcccaaaatgaacttaataaattaatataacctcaattgcaagaggaagaacacgttgaggttgcatactaaggtgtattttatatctgatggttccatagctatgaaagtcttgatgatgccaatgctaggcatccaaatttgcagaagcaaaatctctggtcagattgaaaatgtgttacagtaaggaggaggtctaatctctcatcttttttctctgcataaattttgagtgtgctaaccacacaataagtaagttgtcaataactactgttttgattgattgtattaatccaaatattgaaatgagcatgtttgctgctttactgcttccttgttaacgcctagtaaatgttaattactaagtaaagtttctgaatgaataaataatccagagataaatgttatacccacacctcaggaatgcccactggtgatctacaagagaagttggggtcaaccaaagtgtataaaggtcatacagaaaggactcaggaggtcaatgtaaaggaggcttccatcgcataaagatgaaaaatatgaggacaataaagatcataatacagaaggtggagagcctcagttacatttaaatatatttaaattcatgcattcgcagtgatgccaaaacaaacaactggatgataataaataaataaaatattcactggtggtcgggtgcggtggctcacgcctgtaatcccagcactttgggaggctgaggtgggcagatcacgaggtcaagagatcgagaccgtcctggccaacatcatggtgaaaccccgtctctactaaaaatacaaaaattagctgggcgtggtggtgcgcgtctgtagtcccagctattcgggaggatgaggcaggagaatcccttgaacctgagaggtggaggttgcaagtgagccaagatcacgctgctgcactccagcctggtgacagagcaagactccatctcaaaaaaaaaaaaaaaaaaaattcactggcaacttttggaagagactagagaagcaattcattattttgaaaattgttcttttgggggaaaaactgaagcatttactctgctttgctttgtatcaattatactatgaggcaaccaaatagaaatgcagagttctctttataagccgggctcagtgactcacacctgtaatcccagcactttggaaagcaaaggtgggtggatcacctgaggtcaggagtttgagaccagcctggccaacatggcagaatcccatctctactaaaaatacaaaaattagccgggcgtggtggcgtgcgcctgtaatcccagctactagggaggctgaggcaggagaattgcttgaacctgggaggcagaggttgcagtgagccgagattatgccactgcactccagcctgggtgacagagcaagactctgtctcaaaaacaaaaaatcaaaacaaaacaaaaagttctctttatagaactgctcctcctaacaaatgaagaagtaaaaacagtatatcattgttttgcaactcataatgaaataatcaatcaaaacaatgatcatcaatggctgccaatatcaaacgttatataccttttgttgaaagtacacaacactttctatacaatcatcttgagtaaaaaaagaacaaaatcaaactgactacaagtagctctctagacttagctgctaatttgtcagcaccacaggagctggtgaaacacattaaacaatatcatgtggatgtaatcaacaaacctagacaaaaggtcctgtttcttcaaaaatgaaaagggagagtgagaacgaggatgagggaggaggaggatgtagggtgtggaggaaacagagacaacagagagaagagaggagtcctataggataatttgggaaatataaaatgtatttgatgatattaagcaaatattttccggggctgggtgcggtggctcacgcctgtaatctcagcactttgaggggccaaggtgggcggatcatttgaggtcaggagttcaagaccagcctgaccaacatggtgaaatcccatctgtactaaaaatacaaaaaaattatccgggtgtggtggcgcatgcctgtagtagcagctactcgggaggctgaggcaggagaatcatttgaacctgggaggcggaggttgcagtgagccaagatcgtgccactgcactccagcctgggtgacagagcgagactctgtctcaaaaaaaaaaaaaaaagaagtggggtgggggggttacttgggaatacagtctgaaatgtttagagtagaagtgatatactttcggggatttgcctcaaaacagagaataggaagtgggtaggtagagaggaaaccagatggtaatgataataatggttagagctaatgagcagtgtatggtatgcattatgttacttttttattttgtatatgtttgaaattcttcataagagaaaaaataaatggtccatgtgcacctgtaacataataatgacaagatatgtcagcctaagaataaatatgtcttaagttatcccctttacctcatcttggcttcaaagtaactatatgctttaatcattatagtttgtctaggtccccagagagtgtttttagatttttatttgttagtttatgaacttcagtcaagtaatcagaaagccaatataataaaatagtctttaactttctggaaaacatgcaagcataaataaccatcatttatacttctgtagcaacagtgacattgaatcatactcaaagcaaagtatctaagattcagagtaagtaggattctcacttgtccaatgcaaagattcagctacatctggtgggtaaaggagttaaatattaacttcatcttttagtatctatttagatctaatttgtatagggggttaaggatctcctgataaaaataaaattaataacttaaaactctccataattagacaacatattagctttcatgcccatcaaatatgaggagctgcaaaaagcacagtgtcaaggggtaagtctagtgttctcacgtaaaaatcatcttgcagatacagacaggataaactaaataataatgaggcctaagatttggagtggaggaggagtcccaagtacaccttgatggctgttacctgcacttacaaccaaaacagccattttcatgtcaaatgtgtgccctgggatacaagatctatgtatacattttaaagaattattttattacaagtcactctttggggtccagcaactctactatgcctcctttataacagagaacagattaaaacactgagaatgggaagtttccccttgctgcttcatggatgtaagttgagtagctgcgacttcatgcagactgaaagaaccaagcaaagcaccaaacagtggcattgaagaggttgactgacagtggtctagggcacagtttgagctgcagcacccgtggagggaaacctctgtctagattatcattagcgtagctgatagaggtgagaaaggttctgggagaagcatccaatcacagagctaagtcaagcatcagtccaaatttcagaatgtctgagtgataaacatcctgcagggacaatgatgcaaattggagtagaaaacactgaagagtggccaaggtcttgcaaatgcacatggagatgctaacaagctagcaaaatcctggtataaagccaacactacccatgattacacaggttcataatgccacaggcagtttaggttacaataaaattcatgaattcttcagtgcttggctgggcaggatatgtactgaacaaagcactcccgtaggtactgaaaggcagtgcctattcactaactggtgatgttattcatccgtttcctgaaccaggaacataggagcccctttgtctcctctttcatccctcccagccagtccattgctcaatgtctaaaattggattccccaagatcagacttaaatgacaaatttgagtccatgtagctgattatgatggagatcacagaaagcatcaacaggaagtgagaaacaggaagatctgtgatggagatcacagaaagcatcaacaggaagtagagaagtgagatagagaagaaaggaacacacagagtacattaatgagcaagttatgactatggatgactgggacttaatgccactggagacttctagcaaatgaaatagacatgcctcatgcatcctatttgagtgtaaaaagtttagagtttttatcatccaattctcatctattattaacctgaagaatgctgcttgggtcttcaatattccagcacttctagccttccccgcagtggcaaacccatcagagaaagtcttcaggtgcacgcaattagatgatgagacaaaatgggagcgctgaaagggtacggacagcgtccactagatttaaagagtaccctacatttatcttatagtgtagactatagctgttcttgcttttttgtaccaaatgactcatctttttttccttcctttagaaacaagattgaaaatgtaatctcggttgaacaggaagcatggagatagttcaactgaattggaagttgctggttgtagaatatttctatgcattcttcaagacagtgccatgtgaagcctcttctgacctgtccagttagcttttatttctctctcttttgtgacagcactgtactttgcacatcttattgtttcattcttcacacttttcagtattatacttatctatcttccagtaaattcttcttaacagactatcattttcttgagagcaagaattgggtcttcgttcatctttgtattttaggcatggagtatagtccccaagaaccagtaagtgttcatcaaatgttcatctgttgaatgaataaatgactgtgtgcattgctgctaatgatattcttcaccattttcttcagaatctgcttatgctggtcagattaaatggctttacttgagctgtttccaactttcaaacagattttttttttttttctgacagtgatttaacaccactgaaagttttcagttaccttccagttgttttaaaacatgaaatagctatttctggtgaaaggaaataaaggagaagagatagttctcacttcaatttgagttttgagaggatcgaattgcttcagcccaaggggtcaatactgacaggtcatccctagcagctggagagtatgtcaagataatactccaaaagatatttttatccttcatttgctacaaagataaataaatgcatatatacaaagtgaacaaaagctttgaaaatagtaaaatgttaacataggatagtatagtcactgttattgaatgaatgtttgtgtccacccaaaattcatatgttgaaatcctaactcccaaagtgatagtattaggagatgggtttggggctttttgggaggtgattaggtcacgaggatggagctctcattattggaattagttgcctcgtaaaagagaacctacaggccaggcgcggtggctcacacctgtaatcccagcactttgggaggccagggtgggtggatcacgaggtcaggagttcaagaccagcctggccaaaatggtgaaaccccacctctactaaaaatacaaaaaattagccaggcgtggtggtgggtgcctataatcccagctacttgggaggctgaggcagagaattgcttgaaacccggaggcagaggttgcagtgagccaagatcgtgccactgccctccagcctgggagacagaatgagattctgtctcaaaaaaaaaaaaaaaaaaaaaaaaaaaaagaacctagaacgctccctttcccctccaccatgtgaggaatcatcaacaagatgaacgtcactgaggaagcgggctcacaagacacctaacatgctggtgacttttggactcaccagcctctagaactaggagcaacacatttctgctctttataaaccacccagaaatataatatctatatgtatatagccaccacccatatatgtacacacacacagtttatcaatttttgaagtgaaataacatataaattaacaaaaattctctcacgtgctaccacatacatagataaaatatgtatgtattttatacatacatatatgcatgtatacatacatatacataaaacatgtatgtaccacatacatagataaaatatgctaccacatacatagataaaatacttgcccagatacatagataaaaattcaagtaccatcaaagtctaccttcttcctatctataaagctataaaatgagtggtatgagactaaacagaaatgttctgtgctttttggcacaaacgcatatttgtttatttattatgtatgtatttatagtgttttcatacaaatagaacaatttgacatatatataataaactagaacacatatgcacatatgtatgtacatgtatgtatgcatacatatgcacatatatatgttctacttttgtgcaattaatactacataacgatcacatttcaacatctgtttatataaattcatctcttgtttaaaactgtagtataaagggcacaggcatggactaccaccaagctatgtccatttagattacctattttactattacctagctacaaagaaaacccatgtccatctaaacccttactcatgtgaaaacataaatgaagggcaaactccttgaagtagaattgctatgtaaatatgtaattatacttttaattttgaaagataatgccaaattaatctcaagagtctgggcttgtgttactccatagtcaatgatggcgatggtcctcaactcttgcctccaaaatgcattcattcttgaataactttgatcagatgagacacttatgatctcaatgctcattctcctactactctttggataaccttgtttgacatttttttttacagtgtgtaaagcaaagagaaactccaaactctttacaaatatgctttgctaaagaataagacctatttgatagcacaacagggtaagtatagtcaataataacttaattgtaaatttaaaaataactaaaagagtgtaattggattgcttgtaacatgaaggataaatgcttgaggggtgtatatcccattctccatgatgtgattatttcacattgcatgtctgtatcaaaacatctcatgtaccccataaatatatatatctattgtgtacccacaaaaataagatactaaaaatacaaaaattagctggacatggtggcgcacacctgtaatcctagctccccaggaggctgaggcaggagaatcgcttgaacccgggaggcggaggttgcagtgagccaagatggcgccactgcactccagcctgggtgacagagcgagactccatctcaaataatactgataatgataatgataatgataataaaaataataacgaaattcagtggattctgaataaggcacaataagaagaattttctttttctttatttagtcttaacactgaaaagtcttaatgaatgtgtatctaccatgtgaaattagacagaatttaacagtttaaaatattaatggaaatatttttcatttaatctatttgttctaaacaattgctaaaatattttggttacatctaacctcacaaaggcaaccattttctattacttttctatattcacttttttcctattatttactgggtttcttctgttattgttgttgttttttcctttttgagacagaggttcactcttgttgcccaggctggagtgcagtggcgcaatttcggctcatggcaacctctgcctcccgggttcaagtgattctcctgcctcagcctcctgagtagctgggattacagatgcctgccaccaggtcaggctaatttttgtatttttagtagagatggggtttcaccatgttggccaggctggtcttgaactcttgacttccagtcatccgcttgccttggcctcccaaagtgctgggattacaagcgtgagccaccgcactcagccagtttgttaggtttttattaggtgcaagattgtgctgtattttttaatcaataaaaacacaagcaagccacagctccaagaagtgtacaacaaatgatttgactggagaataatttttttaactaaatacttggtcacactatataagtggcatgtgaagaaaaaacagtcactttgggccgaaaatttcagggaaaaaaacccttatggagtaaaaataactttatagtttattgctgaatgatttacatttttattgatacagctaacttgtatatactcagtgttagttcttaatcatatttaatgcctgttacacatgccacattcctcatgaaactattcatgattcttctccccataccaataatttgtattattccattctcatataacatgttttcggtatgcttttaaattgacaatatattttaatttctcttataattttctatgttctatgttctatagtattaaaagattcatgacctagagacacacacatatatatatatgtgtgcacacatccatatatatttaactttatagaattcttgaatttgactgaatagaaagtggtggccaagaatattaaatctacctaaaattcacagaggtttgagattcacaaaaggtcacttgatttggcttacaggttcaggggagaaaagtaaatttcatggaagaaaatcataaatatttgcgagtagataaggtagcagatgtagacgttatctatagggaaatctgacagcaaaaggaatgagagctaggatgttacattcaggggcctgaattacagtttgctacagatacaatacatccgcacttagcaaaaattacatttataaccttggcttttaatcaaggtttaccataatgaaaagctgtgaagaacttgtatgactcgcttataatttttttggttttttttaagatagggtcttgctctgtagcccaggctggagtgcgatggtgcaatgatggctcactgcagccttgacctcccgggctcaagagatcctcctacctcagcctcccaagtagctgggaatacaggcatgcaccacgacgctctgttaatttttgtattttttttatagaggtgaggttttgccatgttaccctggcttgcctcaaactcctgagctcaagtgatctgcccaccttggcctcctaaagtgctgggattacaggcatgagccactgtgcccagcctaaaaaaattgttattgatgtcactaaaaactgctcaggaggaaaataagtaggtcttattgtgatgaaacaatattttattgaaaaaaattgatcaacattttttatttaaaaacaaaactggggctattttattcagtaatatgccagtattcacatagcaagagttttgagcataggctttggagcctgagcatctaggttcaaatcctgactttaacatttattagtgggacgatgggtaagttcattagcatctccgtactttagtttctttccatatgttaaatatggataataatggtgtctaattcataggattcttatgagaatttaatgcctgattataagtgaggttaggatggtaccttgacatagtagctgttttatcattgttctggattattatatttattatctatgcctattttatataccatacatgcctgtaaataaagtttgtctaggatgccatggaagaccagagttcaccacctttgtggagatttgataggattttcaccattagataataagagctatataatgtatgtttcctctttagtctgggctcccatgattcttggtgccaaacgttttggtttaaattcagtaactccaattgagccatatttctgtcaaattcttccaaatgtcaactatatgtggcttctagtcaatttgaccttgttttactgattctgatttagtggcaagatggtagatgaatgcaatggtttattctcgtgattttaaatttaatcatttgtaattatatacttttaagacgtaaagcttcacctgtcataaaacatgccctttatggcacaatggttttaaaatatggtcccaaaactcattggcaaatggaaaggtagggtctatgtcctttcctcttcaatctgggtgagtttgtaactacttcaacagatagaggatggcaagagtaatgttttgtgccctccatggcagggtcataaaagaccatatgactactaccttgtttgctagaacagcgtttgcttggaaccctgagttaccatagaaaatgtgtgagtatcgtaaagccaccatgctaggaagaagccaaacaacatagcaagttcacatgtaggccttcagaattccaccctccagccattgagtccaacttagctttcaagtcttgacagatgaggctatagatattgcagagcataaacagaacatccctgctgtgtcctatctgaatttattactcacagcatccacggcataataaagtaattgttttaaactgctaagtatcagggtgattttatacacagcaaaagtaagtgggataccctgccaatatgtctacatatttccaaacaactgaaaacatgcacaccccaaaatgttttcttaatgagaaaatacaactcacttttttatttctgtgccttgattaaaaaaaggcacgtccactaaaagaatgataatttttattctgattatgggataaagaaacatatggccatttgtgacatacaaaaagtctactggaagcaaaaagtgggaaaaaaaagccttacgaatacccgtaaactggtgataaatggacaaacaaaatttggtatatccatacaatgaaattttatttagcaaataaaaggaatgaaagactgatacattctacaatatgaatggaccttaaaaacattatgcaaaatgaaagattacagacactagaggccacatatagtatgattccatttatatgaaatgtccaaaataggcagatctatagagacacaacacagagtagcggttgccagaggctagagggagagaggaatggggagtgactgctaatgggcatacagtttcttttggggatgatgaaagtattctgcaactagatagtgatgatagttgcatagctctgtgaacatactgaaaaaacactgaattgtacacttctagagagtgaattttacagtatgtgaataatatcttaataaagctgctgtaacaaaatccccaggatatcccatttctaaataaacgtatttttcccttgaggtcttctgatgtttacacctctttttgttgtgctgtggctttttggaagcagatttctctgggtttgttcatttttgttttatttcagtattagaaccaaccctgcttatatatcctgtctttttttaaatttaaggcttaacaacaaacaaacagtagcaataatcccaattcccgagtgattcaacaagttttattgtgcagatggtaagaaactgtttccctcattgtttgctaccaggagaaaggctgtgaaatagttcttctgggtcaaaacatatggttcacaaaaatgacttcctttcatcttggtctcttcttgccttctgaaagaccaattcctcctaattttaagtttacttttggcaaaatggtctcatgtattaatgactttatttggttaacaaagtaacatgtttacaggcatgggagaggataaatgaagctagaaaaaggagtactgaaaatattaggttaatgtgttattgttttcaagagccatctataacatccttgaaacttacacaaccactgactaaacattttatttagaataatcaggaaccagtggaaaatctgcttatctagaccttgaagcatcattttttttttctgaaaatttcttcctgattacatccagtggcagatactgctatttgcttgtttgcttgcccaatatccaataaacccagcaaagaaatagttgtcttgatggactattaacagccaacccacagtaaaaacaaattctaaaaatttaaaaagcatagtaaccaaaaaatattcactccacattttgctttttaaactttaaaaaatgctttttttttttttttttttttttgaaaccctgaaaaagtagacagtaagccagctcctggaagaattggaaatcaactgcatgagggtctaggaagctgagaggctgaagcagtctcaggacaagtagatagggaggagtcctttttctctcaacaacaaaatcgtgattttgtttagaagtagcaaggtgtcaagcaagaacaaagagctctatttcaagcatctctggcacccagtcatggccttttggcatctgagaggacgacagctagggatttctgggatagttttgttttcctgatgtacatgctgcctcttccttcttcttgcttcctttttcatctttctgctctgaaatgtaagacttgaggctggagatgttgaaaccatcatcttgcaaccaagagttgacaagcatgagaatgatagtaaggtgtaaaagagcaagaagatcaaaggggcctgggattttcatgccatcacagggccagtttcttgctttagactccattccttcagattccatcatatgagaaagttaaaatcctctggttctagtttctgctacttcgatgcaaaaatgcaatccctggcctggcacggtggctcatgcttgtaatcctagcactttgggaggccgaggtaggtggatcatttgaggtcagaagtttgtgaccagtctggccaacatggtgaaaccccatctctactaaaaatacaaaaattagctgggtgtggtggcgcaagcctgtaatcccagctactcgggaggctgaggcaggagaatcgcttgaagctgggaggcggaggttgcagtgaattgagatcgcgcctctgcactccagctttggtaatagaacgagactcgtctcaaaaaaaaaaaaatacaaccctcacttgcagttcctctcaactgggcacaccaccataccctgggtacatttaagaaacgtgaaagcactgtgattgtccccataacggatggaaaggtgctctaaggacgccagacatccagtaacacgcaggaaagtccaggaaaatgagtaattgtttcatgtcctattcagcttttgaaaagtaggggacagcctgtttataagtatgtgaatatatagaacctagctcaattttacatataaatacaaagtctttatatgcactgcattttccaagaatgaaactatcccacaataaatcaaagggaaaatgtgcacttattttattcagaactttaccaaatgttattaatcatacagaaaaatcccattactttaaaatatgctgttcatggcattttaatcattcataccactcacctgcatacgtcagcatttcgagctgtctacttctgtggttttaggtacaggtactacatttatctagagcagtatgtacctttcttattttcatattgaataattaattattgatgataaatatatccattatttttaattcattattgtcctttgatttattttttacaaggtaattgttttagaattttatatatatatgtaagttacatttttggtaaattctctttgaggatagtaatgggagtattacaaaatatgtcttacaaaagagggtgttcagtcttacagggttaaaacctatacggtacatagaagaaaaaaagtttttaaaagaaacacggtagcctggcgtggtggctcacacctgtaatcccaacacattgggagtccaaggtggggcggatcgcttgaggtcaggagtttgagaccagcctggccaacgtggcaaaaccccatctccactgttacaataaaaatacaaaaattaaccgggcatggtggcacacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttatactaaacatactttagtttacataatagagtgtacatttactatacatattttattcaattcacaattttttttaaatcttgctttgttcaatagtgttcattatatacactttgaacctggcttcaaaaatagtacatccttctctattttatgcattttatatcaactatatgtaattgtttcaaattaagattttagataatatcctgtcacattacacttaggttgtctgaccaatagtttcttaaagattcctctatagttacattttctagtttcctttgcaattaagtttagccatataactgggttctgacccatgggatgttggtggaggtgacaaaagtcccttcctgacttagtcagaatattctaagacccctctatagctatgctgtgtaatgtggtagccactagccacatgtggctttggagcacctgaatagtggctatcccgtgttgctgagatttgctggaagtgtaaaattcacaacggaatttagagaggtggtacaataaataatgcaataaataatactaattgatatagtgattacctgttgaagaaataatatttttgttttacatatagttaaataaatattattaaaattacttcacctgtttcttctcagtttttaaatgaggctataagaaatgtaaatactatataaactttttgcaatacatttctattggatgtgctgccaaacttctcaggattcctatatatctttctattctactacatctaccattcatttcttcatcattaattattctatattttttattataaatttactgtgcgctaggcactctaattattccattgtttattataaatctactgtgtgccagctactcttctaataatcacctactgttaagacacaggatgggacatgtgacttcatgataaaaagggggaaacaccctgatataggaactgaattttacaagattttttgtgctccaacttcagtccctgccagaacaagcaaaaggagtgactacaatgtgactttctaaatggttgtattgaggaccacagatgctgggtcctgcctattaggaagaatgggcacactgagttatgaaatgataaaagactcctgtgtctcattctttggccttcagggactgtggtgattttgcaatgtctgtgaattgcccagggcttcagtgactgtggtgatagttctaaaacagggacacacagctttaggaacagtttcagtctataagtctgactatatgtacttcctgttgataaactcatgcttttgtcagtcttttgctaatactgaaaaacactcatgaaccatcctccatttcccattattattcaaggactttagacattcagagttctcagacaattttttcttttgaagagaaaatgtgggtggtttctttacaacttttttgttttgtgtattattattagacactgtctaatgttacatagaaaagaattggttgaagacaagaaagacagcgtctaacagaatataaaataaagaaaaacaaaaccaaagcattcaaataattaatatgaatgagaaaggtatcatttggtttcgtttctactttggctagacagtttcagtacttctgacttttctcataagtctttttttctaatattttaagcattgtttctcttcattatcttacttaatctaaaacagttccctcaaaacctttttaattctcttttaaaatctctacttttatatcttttaaaaatataggcatcaacattatactttaatactaacaaattttactatagaaaattgtgaaagaaccaaaacaacagtcctcttgttgtaaccacaagagcttactaattcatttttaaaagaaattatattgcctattcattccccttttggttaccttcttgctcaagaagtaaggtactttgcaaatggcatagttgatcccagcacctagatatatacatctctaatcaagtgccttttctattcagaaggtaaaagtgtaggtgaattatcagcccaatataataagatcttatcagtgtgtcactagtggagggtgcccaggttcttggtgtcttgatcaaagaattggacaaaatgcacaaacaaagcaaggaaggaatgaagggatttatttaaaatgaaaagtacatgccatagtgtgagagcgggctgagcagcggctcaagtgcccagataaagaaaatcttctggggtccaaataccctctacaggtttcccattggccacttcatgctcaccccacgtaaatgaagtggtggcctgcaattggtctgattggttgtggaaagcaaccaatcagaggctgaagtagagttacataggacactctcctgtgcaaacatctgattggttgcaaaaagcaaccaatcagaggctaaggtgaagttacaaagttgcacttctgtgcaaagactgggcccgcaatcagtctgattggttgggaacagccaatttcccatctgctacacagaaaaggtgggaggtttgcaaagggagtagcctctggtccttatgttacttaggggtggaaagttagggttttgccttcagtttagtcctagggaagtcagcgtgaaatggccttaggttcccttcctccagaccctattctcctgcctcaaatgtgtgatatttttttctcgaaaaaaaaaaaaaaaaaaaaaaaaagaagaagaaaaaagaaaaaagaaaaagaaaaaattcctcagggacctctgcaccaggtgtgctaaaacagagcaacacatgaaaatgtacttccttttcctaatttttcaaaattttaaatttttttattttaatacttttgggggaacaggtggtttttggttacctgggtaagttctttagtggtgatttccgagattttggtgcacccatcacctgagaagtatacaccgtacccaatatgtaggcttttatctctcacccatctcctacccttccccctgctctgagtccctagagtccattatatcattcttatgcctttgcatcctcatagttgagctcccacttatgagtgagaacatacggtgtttggttttccattcctgaattactttacttagaataatggcctccagttctatccaagttgttgcaaaatacattatttcattcctgtacttccctttcaaccacagaaaacaaacaacaaatgttatcatttatgaagaataaaatcttgtgtattttggggagtggaagaaaggtagcacttcttttataagttagtgctattattttataacttgagacatctgattagcttacctataacaaagtggaaatagaaaatatataatatacagtaaactattcatataatgtaactgtttagaatcttaactatcaggcagtgtatttaatgatctttcaagttgcttcgtattttctttttgtccgtttttttaattcaaattattggtttactgacttagatgataggtttgttctttagcagatatgctgaaatgtcttatataaatagtctctgaataaaatcacaatatcagctatcataaaactctacttacatagctcgtttaatatattattagaaacagtcttcattttaaatgcttcttccagaatgtatgcacatattatatagtgaggcatacttaaatattaacaggacattgctgaccttccaaaattgtattcgatgtttcagaagtaagttatgatactacaatcagtaatataaagcattctgctatgactttattcttaaaagagagaaactaaatcacatttacttgaaaactggcatattgaaatgaaacatttccatcctttgtggagatagagaacgctccagattcttgaagagaccatcagagaaaatctaggccaacatttattgttactaaatgcataaatttctctttcagtatcaggaaaatatatgagtatgaacatctataaatatgttttaaaaattatttgaagcctttccaataaaatgacaggaagaaaaccttttaaaaaggtgtaactctacaagcataaagaaaacaggagaagaaaaatgaacaactcaagatgttagcaaattttgggaagtacttccttgccttatggctctaacaaaggctgcaggctcacccactatgttccttggccaggatgaagtatcatatattcttctaatgagctgtgacttctttcagtgtggaatgagacttaccaatgaatatctgcatgctaggtatactcattactaccagaccttcccagctgatagaaatatatttttacaaaacacattttaacaaattgttagtttttattgaaaatttatatttaatatgatagttttccctaagttttaatttataattttatgtttccctatcccttcatcgatatttatttttagtgtttttctggttatttttacttgtgtatttttttataaaaagtttataatcaatttatccaactccagaaaaaaatactacttattatattggaatgcctttaatttacacattaacttaaaaacaatagtttactttataatgttaagccatgcttttcaggaacaaggagcatctttctccttgatttccttttgggttgttcaggagagttttaaacataggtactgaaatttcttgttaaatgtgtttcttgtttttgctgttgttgctattgttgcaaatgggtgtgcaccatccataaaaacttctagctcattacctataaaatgaattttactgattttgcctgtaaattttatagtctgctaacttactaaattattttattggtatttgtttgtgttcatatttgtgtttgttaatattattgttttgtgtgatctcttgaggtaaacaattctatctgtaaattgggatcccattaccactgcttgcaattgttttgcctcgaattggtttatcttgtctggttgcaatggctaatattttcaacacaatgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgaggaatgacttcaataatgagaaacagttcctcaaaataaagcaaataagaacaaatgggaagaagacagaaaacatgagcaatgcaagcagaagagaattatgggaaaattataattgaggtccacagaaagttaggagagaaataattgtattttataaaacaaggtcatgacaatataaaaaaatgaacaaaaacacctataattgacatcctatttagtggtgagaaaatgaaaactttctcaggaagatcaggaacaagacaaaaatgtctctcttaccactctttttcaacatcatattggaagtcctagctaatgcaataagacaaagaaaatagacatatctattggaatgtagaaatgaagctgtatttcttcatagatgacatgaccatctatgtagaaaatctgaaagaatcgaaaaataaccctggaaataataagcaattgtagcaaagttgcaggacacaagattaatatataaaattcaattgtttcttacacaccagcagtgaacaagtggaatttgaaatgtaaaacacaaagccatttccactaacattttcaaaaataaaatactgaggaataaatctaaaaaatatacaagatctttacaagaaaactacaaaactctgatgaaagttatcagaggaactaaatgaatggtgaaatattcagtgttcatggatagaaagactcaatattgtaaagaagtcagttctcctcaagttgatctacagatttaacgcaatcccaatcaaaatcacagcaagttaccttgccttatatagacaaaccgtttctaaagtttatatgaaaggcaaaagacccagaataacccacacaatattgaaggagaagaacaaagttggaaaactgacactatctgactacaagacttactatgaaatgacagtaatcaagacagtgtattggcaaaataatagacaaatacatcaatagaacagaatagtgtggaaatagacccacatgaatacagtttactgatctttgacaaacgagcaatggcaatagaatggagcaaagatagccttttcaacaaataatgctgaaacaactggacatctacatgcaaaaaaatgaatgtagacatagaccttgcactctatcagatcagaagagagacaaagatcaagttactgctactggatttacaagttaacgttcactggttgtacacactcatacaatgctagaggcacttgtatcatctctcattgttccttattttttaatagagataaatgtatttattcttgttcttgaggataaattttaggagttgaaaataaatactccttccataaaaacatactaaaactaaaattattttcaatgattttccatgggaaatttacctatactttgccaccaaactctctcttgcaatagtctttcttatcccagtaaataaccatcccatccttccttttgctcaagctaaaactgtttttctccactctctcaatctccatttttagtccaccagcaaatcctgttacatctactttcaaaatgtatccaaaattcgatcatttctccccagatccatggacatcaacctaatcctagccacacgcacacacccagccttcattactacattatcctctaactcatctctctacttctacctttacatcctacattctaacttacattatttctggctactgttcagaactctcaaaatctcctaatctcccacaatgtacaagccaagacctttacaatggtcaataaggccctatctgatttgtccttctaataccactccacttgcagatcctaccgctcttcctcagtcactctgcaccagccatcttgactcccttgttatcccacaaacacgcactccctcctcagagtgtacatattcttccctctgcctagaactctcttctccaagacacctgcaagatgccctcctttccttccttcaggttttttgtatgcctcttaagtgaggcttttccaggacccactacataaaatggcaacctaccctttgaaatatccctattctacccttatcctgctttattttttctcttagcacttgtcactctctgaaattctatattctacttgcagagagaaaaaacaaacaagttgacaaacaaatatagagaacgtcagatagtttgctaaatgtttccctctttggtttagctcgctagctaacagggccttatgattaaagggacttgatctcttaactgttatattcaaaacactagagcacctgatatgaaatagatagagaatgtagacttcatgtgtatttctgtcaaagcatgtttccttaaatataaattatttgtaaaggataagaacttcaagtacagatatgatactcaaaatatttattctctgactgacataataactgcaggtaattttaataggactagttcctatgaaaagtactctccgtagaccttgtagatcgaagacatttttttttcttcaggccaggtaaactaaatcaaagaaagaaacatttagcaaattcatctgcaactctcatttgttctcattaaaagacagctaatgctaaaccaaagagtaacttcacacatttctaatgaaaaggtctcttagtttgcactcatcacctggccacaattctggacaagaccgaaagtgatcacttgtttattgatcactttttgtccatttttactattacttatctctgcatatagaactggcatagtgaaattagctaaattaggatacaaataagcaaagcccttttaaaaaccatactctgccttttatgttccaagatacatacaagtctgccctccatgtgcattacaagaaaggtttctacagttaaagttatatcagtacattactgtcagagtagatcttaattctttgtgttctggctaccatgatcataatttgaaatataattctaggaatccataggaatcttggtaaggttaaaaatgcaacacccttaagtgaagcacagaggaagaccttcagagtgtcactaaaatgaaatccttctgctgaagcaaagtaaagcacaaaagagagattgaaagactctgtaggtcaattggaaatgttttattcttaagaaaaatatatagtagcccatgaaaggattgcagtgaaagaaatttgcggatacagtcaatagtaatgccacaacgaactgtttttttctaacctttgaacacaattatattaatatctttattcatcacctatctgccctgaaacacaaaataactaggattgttaaaaatatatatatacatcagataagtatttttaagtcttataacctaaaacaactatatatacgtatatatacgtatatatacacataaatgtatacgtatatatatacacatatatgtatacgtgtatatatacacatactcatatatgtatatatacgtgtatatatacacatactcatatatgtatatatacatgtatatatacacacgtatatatacgtatatatacatatgtgtatatacacttatgtatatatacgtgtgtatatatacacacatacacacgtatatatacacatgtgtgtatatatgtatatgtgtctatatgcatacacacatatacatatatgtgtatatatacgtatatatgtatatatatgtgtatatatacgtatatatgtatatatatgtgtatatatacgtatatatgtatatatatgtgtatatatacgtatatatgtatatatgtgtatatatacacatatgtgcatatatgtgtatatatacacatgtgcatatatgtgtatgtgtgtatatatacacatatgtgtatgtgtgtatatgtgtatatacacatgtgtgtatatgtgtatatgtgtatatacacgtgtatatacacatgtgtgtatatgtgtatatgtgtatatacacgtgtatatatgtgtgtatatgtgtatatacacatgtgtgtatatgtatgtgtatacacatatgtatgtatgtgtatacacatatgtgtgtatgtgtatacacatgtgtgtatatgtatatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatacgtgtatatgtgtatacgtatatgtgtatatgcacatatgtgtgtatacgtatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatgtgtgtatacacatgtgtgtatatacacgtgtgtatgtgtatatacacatatgtgtgtatacacatgtgtgtatatacacgtatgtatgtgtatatacacatatgtgtgtacatgtgtatatacacatgtgtatatatacgtgtatatatacacaaatgtgcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtatatgtacatatgtgtgtatatatgtacatatgtgtgtatatatgtacaaatatgtgtgtatatgtacatatatgtgtgtaaatatgtatatatgtacatatatgtgtataaatatgtatatatgtacatatatatgtgtgtatgtatatccatatatatatatatacacattttttaaaaaataggtataggttgagcctctcaaatccaaaaatcccaaatccaaaatgctcccaaatcagaaaccttttgagggctgacatgacacacaaaggaaatgctcattggagcattctggatttcagatttttggacttgagatgctcagccagtaagtataatgcaaatattccaaacgaaaatccaaaatttgaaacatttctattttcaaacgttttggacgaagaatgctcaatcagtatcagattgattgattttgagtcttttaactcattcagtttttgagtatagtccccacaaaataaatcccaatttaaatcaagtacttgcattgattctcaactggaaaaaggtcattcccctttgagggttcaataaattcctcagtggggtttcctccaacattctctactacagacctgattaaattactgaaattctaacactgtggttctcaaagtgtggttctttggccgtcagcatcagcatcacctgaggacctgttagaaatccggattcctgggtcccaccctagacctatggaattagaaactctgactatgggcctcagcaatccatgttttaacacattttctaggtaattccaatgcgttttgctgcatcgttttggagtgtgcatggtatcaaacaactctacaaaaatggtagcctgcttgcttttccattttaggtctctatgtctattgccaaatgtaaagggtagacttcagaccaaattttgcatgaagcattagtggtggtggggcagtctaattcttctatcattgcctgttgttttagagcttcacagtcttcaatcagaagttgcaaattaacatgactaagccattatcttattgttggctcaaccagccccacaacaatataattcttcaagaatggcattatatgccctctcacaacctctcttcttcactcctaaagatctcccttgctactactcacctgacaagtcatacttctttgattattacacatttctacatgcaattccttctgccttcatctttcttgaaattgtctctgcgtagacaacaccagactaaatgtcaccatattttaaaaagctattatcctctccaagcaattagtcattctgtcttctatgttcccacagcatttctattgcattaaagattatgttttattttaattatttgttgatgcaattgtttcctttctcagatgataatctcttggagagggaaaaccatgttgggttatgccttcatcactgtatgacagtatgattagcacatagctggcattcaataagtatttgttaaatgttgaaaggttattttagtaaacatatatctctgataggatggtaccagagtgtcaattgttcttttctaaataaaaatgcttcactaatgtccatgtatgttgttttgctagaaagcaaaataaaatcagataaataatggataggcccatcagccataaagaattggtttttttgctagcaactatcatgctaattggtaaatatttacatatgcaagctaaatatgcttggcactgagaccactccagagaatataggtgtaatcaataattccaattttcttgtatcaggacatgataacctagagaccaaaacatttaccttctaaaaggaattgtcaagatctcagtaacactgggttgataaacagcaacatatttctaagaaacttctttactattaacaataagtgatttgtctttctttgaaaacagtgagacctatcacaatccatttttgtctcactaactgagtaatatcctttgttacttaggtactttgcaaagattgtttcaggaaaacattcaagggaatggttctcagtagattaaaccatttagtataatcatcttgattccaaacacaaacacatcattcgacaagtcatcttaacaccaagtgtagatgttagggagttcacatgccagtaaagtggtattttgaatttcgtataaaactgttttaagttaatattcaaataatcatgtaaacacaataatttgtttatgagtagtagaaataaaaagcaatgtttgaaaatgacaatatcactttagataactctactgcaaactaagtttacttcactcaccaaaacgcagtatgtaaaaaatattaacatttaaagtacaaacagttctcgacttaagatattttgaccttataatagtgtaaggtgatactcatttagtagaaaccgtattttgagtacccatacatgcattctgtttttcactttcagtacagtattcaatcaattacatgagctagctttattataaaataggtttgtgtgaaatgattttgcccagctctaggatagtgttaagccagcacatttaaagtagggtaggctaagctatgttgtttcgaaggttaggtatattaaaggcatttttgacttgtgatattttcaacttatgatgggtttatagggacctaaccacacaagttgaggggcatttgtattagaaatcattcagaaagaatcaactaaaaaacttcctaaacaatggttgcattttggggttactaaacattcaaaggtagattaaatcctctgtgagtaagcgagcatttaataccacctgttattgagtcttcactgtctccaacccccctgcctgcttctcataggacttatcaatttgatgatttgtcccaaaaatgcattattgggtaggtggaatttttgtcccaacaataataggtatggaaatatcatgagttttagagtccattttcttgggtcctagcttcatctctcctatttactgtgagcaagccacataaattcacattttactcatcttgaatacttgtatcatatgattattggagcaactaaccatatacatataattttcagtaggattattaacatcatggtatacataaacaaaaagttcccaatcctcactatttctgaaacgaggatttccgtaagtttcctgtatcaatattcatctctccaaaataattgcactaaataattcaattgttaccaaagtcttgtgcaggctgctcatcagcatccagagacatagttcactgtacgtcatctgctctaatgatttaattcttcctattatcagataaaaacaaacaggaagccaggggcacaggagccattttagatctatgtaaaaccttccatggcacaatagctctgctcgattacttctgttaaagcaggcacattgcacaatagttatatataaatgtgttagctatatacagatttagaattcacttacacaatggaaaggtacatatatattgttacctccttcactgaaataatgttttgccactttgtcccagtatcatccttttttaaaaacttctaagctcattttaaatatagaatatgtttactgggtgtgtgtatatgtatgtgtgtgtgtgtgtgcgcgcacgcgcgtgtgtgtgtttgtgtgtacgtgttgaggacatgaattggcatacagagtgtaataggatagtaacacatgaataaatgctctgttttccctgtttgatgccaagaaggtagccaaaaccataatcaataaagaaatgaacaagtatccagaggaaaatcacccttcaaaaactttagttctgaaaatctagattcatgttaaggattgatatattgtcccaactgaacaggctattgggatatgggagttaagattcggggacagtggaaatttgcaatcagtcagattaaagagaggtttaatgagcttcctcaaacacagggaaagggatgaagttgtgaaggccaacatcctactccctttacagagtttccaaatgttgtgctgagacaacctacttaaatggctgtagaggccagataccaagcacagagcatcatcagcaaaaccttccgtgttcaagcaaggcagggcattgtggacaagctgtcctttatgtagtcatgtttacttggctattaagcatatcagctatgaccaaaatgcactgaaaaccaggacacttacagtattctggactctacctggccctttggaatggaagtgggaagaagtagaagaatgcaaaatgttacggagattgaatttctcaccagtcagattgttggggttactagttgctgcaggaacagattcaaccaatgtagagaaacaaggaaatatggcttattacaaactaggttatagaatcaaaattcatgtgcatttcaatagcatcatgaaattatggagttaggaacacaatgattacaattaaaatatcatgttctcaagaagaccaggtaacatcatggaaaagaatagaagtaaataagaaggagagattcagtagaaaaaaattcataaatatatgcatttttcaattcaattcagaaaatacattacataatgacaaaaatgggaatattttgtgtttatatgatttactatttataatgcccttttattatatgttttgttacaagtaggcaagaacatataagaaaaataagactcagagaatttcaattttatattcacctttcttttcaaataaattaaagtatggatataacgttttctcctaaggtagagagtagtgtgaagaagcctgctttatcaaaaaataacgtgctggtggggctgcggagaaaatggaacacttatacactgttggtgggagagtaaatgagttaaaccattgtggaagtcagtgtagtgattcctcaaagagctaaaaacagaactaccattcaacctagcaatcccattactgggcatgtacccagagaaatataaatcattctattataagacacgcatacatatgttcattgcagcactatttacaatagcaaagacgtggaatcaactcaaatgcccgtcaatgatagactggaccaagaaaatgtggtacatatacaccatggaatactatgtagccataagaaagaatgagatcatgtcctttgcagggacatggatggagttggaggccattatccttagcaaaatgatgcaggaacagaaaaccaagtactgcatgttctcacttataggtgggagctaaatgatgagaacacacggacacatagaggggaacaacacacactggagcttatcggaaggtggagggtgggaggagggagaggatcaggaaaaataattaatgggtactaggcctaatatctgggtgatgaaataatctgtacaaccaacccccgtgacacaagtttacctatataacaaacctgcacatgtacccctgaacttaaaataaaagttaaaaaaagaaaggctaccttactgactcaaaagtttagtgttaatttaccctacatcatgcttatcatgctggctaaaaggtaaattaaaaagaaatcttgcaagaagtatgtcatatcaatttattttatcacatgatattgcccaaagagggtgagtcctggatttttaatgtggacatatatgttgcggcaatgaagaggtaaatgaactattgtggcaggccaggtctcactaatgcaggcctccacaacaactgtttcagcactgactgagtggtaaagttacatattaaaagctgatagagccagcgcccttaaacaaaggctggacggtaacaaaagcccaccaagagttttgcccaggcctttcctgggccttgaagcatgacaagataatgaaggaattcttaacaggacccttttagaattaaaaaagctttattgggggtctgaagaaactccccaggactccacaaacaagtttactgggcatctgaaggaactcccccaaactccatgatttagccggagataagataagggtaatcatcccagcacctggacccatttagataaagtaaatttactgaggctccagaggaatgtcttcaggaatcagatcttagttacagatcagaagaagttaatcatttatgtctttagatggatacacacttacatgtagacatacagcgtagaaggtatataagctctggaaaactttatagttttgagttggtctggggataatttccaggtcttctccctgtaaccacttacagaaataaaaactctctccttttcccgttcatctgcatctcgttattgggccacaagaataagcagcccaatcctcagtttggtccaggaacactatcatatcatgggcttttgtgaagacattagacaaaactaattatgcatttctacttcatttaagtcaaacatgcatactatgttggaaaaaaatcagacagaagagtgagtatggaaataaagatgattactaaattcagtataggatcaaaaccatcatatcactcattgggagatagtttatctctctcaattgagctggcagtaaatattttttcccataaaattttttctcaaacacaaacatcaagcacattttatgacaaaattatttttggtcatgttttcaaaactgtacttccctttattaagccggcatggatgagcaagatttttataatgcgaatcatatttgtcatagagtatacacgaggctttttaaaggattataacatatcaataaattacatggaaagaatatttactctgaattaatcttatctagaaatggttttgtgtttatgtggagataaatattgttcagttatctctatataatagatgtgataaatcacattctagtagaattttttggaatcaaagttaatagaagacttattttaaaaagagatagggcttatttttaaaatggtaccaggaaagtggaaaatcagttagatttactgcaaagacacatttggcttcaaatgacgccacaacaacaaggatacatttaatcacatttatttcctttaaatatcccttccgtagctttacaaaataacaaggaaatattttgttgtctctctataatttacaaatattatataaatgtgtgtataaaaggcaatgaaaaattatcatctgtctgtgtggtaaagtagacacagatagacattaatacgactataaaaatgaatatgagttagatttattagtgaggcatttttatagttgtatgaatgtgtgtgtgcctgtgtctaatttaccacacagacagaatttttcattctcttttttctctttttaaagtcttcttcaacacaatttttccacccagtttttcttctgtttctacagttagcatagatttaatgatttgtactactgacctagtatatttattatatttatatagtgtactagtaataaacaatgagattatatagaagatatacattcctgcctttgatgggctcacattttagagctttcttcataaaggttaccagattccctctagctcagattactgccttctcagaccacccacactgagcccactcagttctaactccatttatcaattaaccaaaaactcccaaataactgtgtaggttccatgagttcaggagattccacttcaactaatctgtgtatcctacagggctagaattctgctgaaaggcatgcagcgatgcaataaattgccaaatgatatatatatcacaattatgtttatcttttggtttcaccaagtggcttaaactgaatcaactagcttcctctaaattcccatcttcttcaaaagtgtctaaaagaatgcagtcacttagctaagttttgacagaaaagaataagaaaagaggaaaaagattctttgcaagttctcaaaattagaagttagtgcacaggtatatatacattttacctttaaataagttttctcctctgtctttgtaaacttttatttctattcctgacacctaggatatgcttgataatagaatttctgtacttgaaagaatggtgactctcctgatcagttataacagacttagggagaacatttgtaatataaatgaaaagtgtgagttgagttagaggatgcaaatattttggaagaaaacaataaatgtgctcatatatgtgaatattttacagttttaagatatgggcattcataaggacagaaaaaaatataccgaattgctctgaggcagtgctaacaatatataaatagaggatggattggatatcaagctttgatttctatattaacaggtgagttgtgataaatgataatggaaaaggttaatgcacagagcgaagatctatttcaacttgcgggaatgaggatacacagtacttgtcatgtttacacaccttttaaaaattactctagttcaattcaaagattcagagtattgttacatttactatttcagaaaatttcttcacaattctgatttgtctgtatgtttgtttgaaaatatgtctcttgtctgcttcagaattccaaaacttaaaaatgtcaatgatgccagtatatacagcaattaaactatatataaccatcttataaatattcggagaattatgaataactttcctaaatatcctaggtttactttttatttattcttctatatttgtgttgttatattttatttcacttagctaaaaaaagttgaggatttaaaaaacgtttttaaaatacatgtttctgtttacgtctgtaatagaaatttgttaattattcagcaagtaaataaaatgaacttttattagttaaaattcagtaagttaaattaaagagtacatggcaacattctactaccaaataccacaaagaatagacgatattctaaaaatgtttgtcatagaaaagggagaacttttgagattggatctcctagtggattgttttggctccattatcatgaattttacaaaatcagacccatagagggagtaattcatagctattaagagtttcaggcattttagtagaaattttcacttttagtgactctttaaatcattacaataagaaacaaaatatccactatcaaaactatgccactcttaaagccttgggtttaagggccatattttattagctttatttttccattatctagatttgatgtctcaattaagcaatcaatatatacatatacaaacattcatgatggaaacataagaaaaccgactcaccaaacatttgattgatttacccaaatcgagaataataattaaaatgcaagtcttttaaactttgacatcccaataaacctccatatattgcattcctaatactagttttcaaggtaagaatatcttgctctgtgtccacctataatcatctagagtcacgctattgattaaaaattgagttgtatttgcaaattaagtaaatattaagagtatggattgaagcctgcacaaaaacaagatgaacttattgtctttaatcatttgaaatatgctctaaactatagtggctgaatacacccaaagcaattatattgcttttcttgaacttggtaaagaccaagagggacaaaaaaatgataattttcacaacaaaattccctcatatcttcttctgctgggtgacatattctagctacttgatggaagattgcagctataaactctgaggactcatgtcattaaagaaactcacattgtcaagaagaatcaaagatatacattttatataattaaatagtgtatctttgccatatcttctgctgcttactccttaaataagagtgaacataatatttccagatttgcacagctaaaataaaatgacactatgagagaaataaaacggatttttaagatacacaggtacatagtccattttgaaaatttcacaacttagatcttaaaagtaaagtaacaaaccattcttaccttagaaaattgtgcatttacccattttgtgaatgttttcttttgaacatcttctctttcatctaaaatgcaaaataaaaaaataaaagttaggaagcaactttaaatataattcatattttacaaccaaagtaactttccattatgatgtgttagtgtttttttacatttagtattacattcattgataaatggaattaaacatgagtgatgctggtttggggcatccaaattaaaattacttctgaaaaatggccaggcgcggtggctcacgcctgtgatcccaacagtttgggaggccagtgaggacggatcacttgaggccagtagtttgagaccagccaggccaacatggcgaaaccccatctctactgaaaatacaaaaattagccaggcatggtggcatgcacctgtaatcccagctacttgggaggctgaggcaggagaatcatttgaatccaggaggtggaggttgcagtgagccgagatcatggcactgcactccagcgtgggcgacagagcaagatcccgcctcagatttgtaatatctgaaaaacaattaatatgaccaaacccatagtcgttcaaatactgtatgattataaaaaaatagtctcctctgaataacagtatttattcgccagttatgaatagatactccagtataattaaaagaaactctcagctgtcatttactccgaaaaactatttcggagcctttccccatgccatccacccaaccatggagaaatgattattccttcctttgcagcatctacatactctaacatgggcctgatctcactatggaagaggtttcctgatgagcaggagcatggtttagttatctttgcttcccagaacttagcacactgtctgaacaaattaagagctcagaaaatacatctgacaaatacgtgcatgctttaaggaaggggagattctacaactctaaaatttctaggacctcttttcatctaaaagtcagaacatttcaaataaaaatgcaaatgatactcttcatgccttacatataaatactcaaagaaaaaagtccccaaagatttatactaagggattagggagaaaaattattaaaaaacagcttcactgaattcatgcttctacaaatgatctttttgcccctaaactggaaattagtattaagtcaaatggacagaaaaatcatcaatcttgatatattaaaatgtttttctccaagcaaaagactatttttttaattattgtaaatataatcatattagttaatgttcagtaaatgaatgcatctgagagatatttaaaattgataaattttatattttatctacttggattaaaagaaccgttattaaaatgccctttacaaagtaatcatatttgctctcatatatttttcagtagtaaatctccgttgcttctcttaaaaacataaggaatcactttcgcataacaaatatatgcatgcaccaaaaatatctgtttatctttaaatcacaatactaatctataagtagattcctttagtcaatatgagaaataacagtgaataaataaatttcaaactgtcatcttaggtgagaaattttatttagcattacaaaatacatttttcttatttaattatgttattcacacaagcttctatatgtatgttcaatatcaacattattcatatggtatatgataaatcttagctacaatatggaagtatttcctttgttgacaagggtgaataaataaaaacagatagtaatagttttcaaacctattctagcctccttcaaatctttactttcataaaattaatactagcccttccaaaataattttaaaaagaaatggaacatttcaaatggtcaaaattaaaccatcttcatagactttatggaggaagattggtcaacgcatcatttatcagtagtatatacatatattcctaaaagtaaatgaccttatttgcaattccacttatatttcctacatgtgcatgcgtactttctgtcagaaagcagagagtaaatgagtcagttgaaagcatacattcagatgtctttgaaacatacccaaaaccctctgccaaaagctcaatatgaggtcttttgaagtgatttaatctagaggcttttaagtgaaaaatacgtagtagaataaaatttttattcttttcaattatatggacaaggagtaatttttaggtaagcatcgaaggcagcacgaaaaccttgacattatgtgcaaagtgttacttatttactgtgtaaataacactaaatgtgagcttcaacatataaacatctttgctagttgtcctctctcacctctacgtctttaatacaagaaaaatgtcttcaatgaattattgtcttattttggtatagtagcatatattttcttcaacataataattattaatacaattaattgtattattattataaaatacataacaattcttagtgccttactattcataagtttgttttaattatgtcttctcaatctgtatgtaatttactactttatacataaacacaagctgagaaggaataaagctattaagtgacagaaatgaacttgatacagattttctgaatcaaagtccatggcttttcacattgaccagatatctatcatttacattataattgcataattaacaatacagaataccataagataatcagagtcacaaaaggtgaacatattaacgcaaatgcaaaacaaccatgaaatcagagcttctattttgaacaactcaaggaggttccatgtatgttgtaacctatgtgaatagcgtcctggaatttggcaatgcataacttatttgtctgtatgaactgatctagaactgaataatgagccttctttaatggtgctggatgatatggttgttaatacttcaaataataatgcttttacatttactaattgatatttggtatttcaattttcgtcttatatatcattatggaaacattttaacatccaaaaatcaatcaaaatttttgtgtccacacttttaaattccccataaatacatatttcttataaccaaaataatattctttctttttcacttattttatcataaatctcatataagctgctctttccttttgtttgctattagagactaaatcacaataaacatgctcatgcactcacttcttttttgtttttataattgtcttcgaaaaaattatcagttcaacattatgaaaacctttatgacttttgctaaatatctttataatactttccaagtgatcacacccacttctactggtagcagaaagaatgaggttgggaattatcatctcagccgcaggtatgtcattcataggagtttcgttgctttagtcttttacggtattgctgctttgtttagatgtaaggagatccttgatgtttgctttaatcataattaatttgattactaatgaagtagaagatgtttcatgcatttatttattctgtatgttcctatttttgtcaaaatacttgtttacatcctggctcatttatctattgagcatttaatattttaaaattaattggaatgagataattatatattggtaattcttaaacatttcaagtcatgggctccatttgattatctgatgaaaataatgaaccttctctatagaaaaatgtctacacatacatatttgcatatagtttcatagagttcactgacctccttgcagaaaactcctataaccataaaatccaagttaacgatcaaaattaagctactcacttttagtcagtgaatggacatattttcccaagtggtcatatgccttttaatttttattttagtatgctaaaattttatacgtatttacttgaattgatatatttttattgctatttgtcatattgcttaaaagttgactattttaagctgtatacccttagttaacctaaagccaccatacatacacatcacacatatataaattgttctagaaactattttgatacgttaacatgatgtctatttctgtagtcacatagtctatagtaaaacatattaatgtgcaatcagcaacaaagcaaatgagaaaagaataaagtgatagctgttttattacaaaatgattatatgctcctgtttagtcatttcaagcagcacatattctatttcatttcctttagggtttgtttataactgattttattttactaataaaaacatgcatgtgcatattaataagagaggcaaagaagaaaatctctcttaggaaaatttacttgaaaactgttccctggagatgtcaagaagtgaagaaccactacttcataaattgcaaaaactgaccaacgttttattttattctctctacggggaaatcccatataaaattagctttctaacatgacataaaaattgtatttcctctcagtaatctttaaccccttctaataaagttatttttattcagtatatgtggcctttcatattttttaagattagtacaatgaacttttaccctgttattaacttttatattccttagtccctcaggaatataaatgtgggatatattaaattgcaatattcttgattcacaagagcaagttactgcagaagaatgatactgggcaaactgagggaacattaaatctgtggaactggcttccagtggctttgcaggacttattagaattgtggccttaaaattgccaagccttagcgtctttaactgtgaaatgagaatattaattgctctttaactcatggagctattgacaggatataatgagatcatttactcgtgtaataatttataaaataaatatttacagaatgcttactatgacctggacattgcactagttactgaaaatataaacaagattcagtctgggagagctcttagcctagtagataatagacacatcatagataaatatgaaacattttgcataaacaaaaatatatataaatttaaagcgtattataggagcatggagaaaggaatatgtagccacatgggtgttagaaaagatattttggagaaggtaatgggtaggttgagttcagaaggatgagagaaagtaaagaaggaataaaggtaggaggaggataaagatgaatctcactgagcagacagtaaggacaaggacagagtgataagaaactgaaagtacacgctcattcattatgcaattctgttttgttgcactctaaaatgtgagaaagggagtggcatggaatgaaattgcaatgagagttaggagcgagatgctggagagcctccttaagacctcttctctgccatcagataaacaatgtaagtgaaagcatttaaaaactgggggaaaaaaaaaaacagaaaaacagttctataaacactaacaattattcccattacacaaagcaattaaccataatctgtacaagaaaataaaatttttttgacacaaggtctcgctctgttccccaggctggagtgcattggaaccatcacagctcactgtaacttcagacccctgggctcaagcaattctctcacctctgcctcctcagtagctaggactctaggcacacatcaccacatctgtctaatttttaattttttttcttttgtaaagatggggtctccccatgttgcccaggctggtctcaaactcctggactccatcaatccttctgtctcagcctcccaaagtgctaggactacaggcatgagccaccacattcggcctagaaaaacattttttaaatgatatttccttgggggctagttaatatgttaattgaagatcttcatccctaatgtgacacagaaaatgtatctttaaaaggggaagggaatattaaagttgataccagtttagaaactcacgtagtgaagaaatgcaatgggatgagttaatttcacttaaagaaagaactatgaagccgggcgcagtggctcacgcctgtaatcccagcactttgggaggccgaggtgggcggatcatgaggtcaggagatcaagaccatcctggctaacacggtgaaaccccgtctctactaaaaatacaaaaaattagccgggcgtggtggcgggcgcctgtagtcccagctactggggcgtgaacctgggaggcgcaacttgcagtgagccaagatcgtgccactgcgctccggcctgggggacagaggagactccgtctcaaaaaaaaaaaaaaaaaaaaaaaaaaaaaaaaaagaaagaaaagaaaataaagaactatgaagtaatatgggagagcaattaagttcagtctattctctgcttccatcaaacatgagaaaaaaatgaaaaatatggaagattaatgataaacattagataaggttatgtgatattttggagcattataaaggaaggaaacaaatttaggacatatttagaaagtggatttactgtgccattaatattacaaaatggcagtgcagagtggaggaggctgcaatggaaaatggtatgaaaaatgctttctattaaatctgagtaatagtctttgattatgggatttttctaccgcctgaggtgacgttagtggtcagcttacaatgaggaggtctaaaataattaaacttctgcacgaagaacagaaaagctgttcatgtcaaagatatttctttatttcccattcgctttacagtcaatgtaatgcagtcttcactgctcatcatcctacaaaagttgttcttaataacatcacctacatcctttctcatttccaagagagtgactgtctggatcagagctgtaatcccagcacttagcatagaatgtgttacatagtagtgctcaataaaggtgttttaagttaacgaagaccagatttactttttagtcctcttctcatttttctcctctgcagatattaattctattaaactctggtaggcagaataatgcctcctcaaaaatggccacgtgctaatccctgacatctgtgaataaattatgttacatggcaaagtggaattattgcagatagaattagactttctaattagctaacttttgatagggagattatcccagattatctgagtgggcaggatttaatcacaggggtccttaaaaggggggaaatgttggcataaggggagaattagaaagcactatgagaaggacttggtccgaggtggctggttttgaagatgtacgaagaaggccgtgagccaaataacgtgggaattctctagaaaatggaaaaggcaaggagacagattctcccctggagcatccaaaagtacacagcccttctggcatcatgatttgagtccagtaagttccagtttggatttctgacctgcagaactgtctgagaataaatgtatataattttaagccactaaatttgtggtaattttatagcagcaataggaaactaataaattacatttcatatttaaggctattaagtgacaaatgtgtactgacacctactaggtggtagaaaaacaactgtgagaaaggcagtgtctctagcttttttccttctagcttagtgagagaagcagacacaacaaaagggtatgttgatacaaatatacagataagttgcctgatgaagaaactacagtcatgtgacaatcatatattaaggaaactaccttgaaaaatccagagcttccttgatgaagtgacatctcagctgagttttgaaagttaattaagagcagagagacaagtggtagaaaagagaactccagaaaatcaaaagagcaggtgaaagtgtcaggatgtgagagaaagagtatggtcctttcccagacctagagatggtggaggaggataaaaatggcagagatgaccctagaaaaagtgaaattatcatcaacctatttatgaagagcctgaaaatatagccagagggcagttcgaaatcaaagcagaattttaagtagggaaatagcaatgtcaggcttggcttttagaaataaatttcacagtgtagagaatatttggggataaactgtaaataagaagacacatgagctgattatacctataatccacgtgagaagtaagcatgacttgcattaatgaatggcagtggggctggaaaaggagtaggtgcattcaagatgtgtttacggggtagtattggtaagtactaattattaattatatgtggagttaggggagttggatcatggataatcaatgataaagctaaattccctgatggagaaactacagttctgttacaatcatatattaagagaactaacttgaaaaatccagagcttctctgatgaggttacaggctagattattcagaatggcatataagggccttcacaatttgactccagtgtactcctctaaacatattatcgattaggcctgttggcagtcacccatatcccaaaccttatatacatctaccaggtctgccttagtcacacaagccaaatttctccataaataaatcatatgctttcttgctttagtcctttgttcatgcactccctagaatgaggacactcactattaagatctaggtcgaatgtgagggttttcacaatcacacttatctccctggcataacttatcaatcaatccttctgatatatacatatgtgtaggcttttttctaattatgcatatgtgttacacacataaatactttaactgtatgtgtatggacacacagatactttaattgtgtgtgcattataatttataaagtgatttcaaatatctcatcttgcttacactcacacatacacacatacacacacacaaacagaaaattagtttgttgtcttccaataatgcagcccaaatcccactcattacctcctaaatgtgaccacacttagatgggagaattattatgtctttgcaactcctggcaccaaacatggtatactgaagcagaaataggtacttagtaagggtttgttgaataaatcaagtgactaatcaatactgtaattaaatctcagatctactaagtcctagaccaatgctttccccctgcacttcatcatactgctcaaactactctgttaattatagaccttctgtcaccaattcatttcctaaattatccattgagcacccattagacataaaactaactttcaatgacttctccccaaaatttagccttggaactgaaatattgctacttattttcatcactacaatgaataaaaaattaagagaaagaatatttcttgcaaacaatctgcctttatttctctaggtgaatttcactctgtaatatgatataattgccctttacttcatctttcatgactgtcatgcttctgacacaatgtaaaatgctatggatgacctgtctgttcctttgcctccactgcaaacgccacttctttctcaggtaggtcaattgcttttttattgtagggagttgttggactcagaaaccagattggaaagccatgtcagctcatattgaataaaagttctctcccattccctgccacttaatcacagaatttatgctccattagcaaattggagttatggtgagaacctaacataatcgcatagttgtatattcataaaaattgcaatgctctatacattggaaacatagcacaagtattgtagaaatatacttgtgaagaattaatcgaagttgcatgaagtaggacataatgacaatgagattgaagaaatgtattagagtggaagaatgatcagaactccaagagtatatgaaaaggtgttaagtggtctcagttggaaaaacagtgccatctggtagattgtgcaaacagttaattcttatcctcttaaaattgcatgtgttagatacaatgcaggccggggttacatcatacactcatttcagagtcaaataacctgagttccaactccagtttcacatctcattatctctgtggccttgagtaagttacttaacctctctgtgtctcattgcctctatttgtttcatggtaatagtaataaagatactgaattgtgaagactaaatgtgacacatgtatgacatattaatgctgagaaagagaaaaaaatagacaaaacctataaatctttacttccaaatatattacaacttcccgtgggtcttctgtataaatgacattatttcataaaatagacacgattgctacgtggcagccatgttaataattagtaggatttttatagtatttgtaaatatgcaaaaaattcaagtcttctcgatttgaaagataaaaacaaaatatgaaatgatattcacataaattatacctcctcatgctcaaaagaatgaagtaagtttttagtaataatggaaataatggatatttctgtggtgcattataatttataaagtgatttcaaatatctcatcttgtttaaacatgagtatgtgggtgtagacttgttaggagtaaaaataagttactattaattagtatgcagacttgaaatgtgctttggtagtgttcatgagaaagatgacttatttttgttaaagtaataaccatagactaattatgacagaataaatcaaaataaggtcaaggtctccagtgtaatttagaggtgaaattaactacttggatattgtagcagaactgctaactagatgcctgtttccatacagctgcctactcaatattacttttaaaagattcaaattctcccctgaaaatttaaaaaaatacattgttctgtggtgtatatttatctatttttatgggttgcaaaatacttctttgcaaaccaaaaggaaagcaaacagccaaatgtgcacgacacacaacagccatttccaaacatactgttaatgagatgctttagaaacagacaaatggtcaaacacagggcctggattataaggggatatttaaatcacaagatgtatttactcaacttacactatggagtaaaggttaataaaatggcatagtagatgaggataatgcctcatcccttatttcaccgagccatccctgagttcacctataactatagtgaacggattctgtggatgctgaagattcctcaccacaagcatccacatctctctgtttctttgtgttaaggctttcttcagtttaggagggcttggtaagcccatttgcagggcagtccagaagtgatagagatttagttctcccaggggcaaccctcaataaacgagggacagaagtctatgtattaaaaaggacaaaaaaaaaaaaaaacaatggaacaattgctaagcatgccctgtagggctcctcaattgttgcatgggatatgtaatccagaatggcccataggagcatcgttattgtctgctctctgtagtggaatttgggcccacatttcttggcttgatcatgcactagttatgcagtgttagaaaagactcataggccgggtgcagtctctcatgtctgtaatcccagcactttgggaggcccaggtggacgcagcatgaggtcaggagttcgagaccagcctgatcaacgcagtgaagccccgtctctactaaaaataaaaagattagccgggcgtggtggcggacacctgaaatcccagctacttgggaggctgacgcaggagaatcacttgaacctgggaggctgaggttgcagtgagccaagatcatgccactgcactccagccccgacaggagttcaagactccatctcaaaaacaaacaaacaaacaaacaaaacaaagaaagaaaagactcataagccacaccaaacccaagatttccagtctgaaaagaggaaataatcgtggtaaaaaaactcttagcttcactttgatgaggtatcctgtaaagcatcgaaagtagtcttaagcaaagacttagtacaaagtaagtgccaatagagatcagtattattattcctgactatatatttaattgcattagaacttcttgaacaagttggtagtttacattatttgctcatcggtttctttttcttcctcctttccacttgccatggttcaccatgggtggattacacatcccactcactgatgtggccttggtcatgtgacttgccttgaccagtggaacacagtcagatatgagagtgtgtcaattctgagctaggggcttaagaatcataaagtgttttcacttttcttggtccttcctccctttgtcaggggaagtacacgcctcaggtagcctctgttcctaaaaggagagatgcatagagctgacctgtactcaatacaaaattgaacctgacatgtgaataagaaataaatgtttgttcttataagtcattgagatttggatttgttttttacagagcattagcctataataaagctgactaatatagcaggtaaatagtaaatgtggcccatagaataaaattcaataatgatggaatgtatataacctcttcatttaaaaaagagagggttgtattccatcattaaatttaaaataagctgaagaatgggttttaaatgaagtattaaaagctttccaaaaattgccctttcagaatatattatcttttaaatcttggtctttctccttaccataccattcaaaatttaaacattaaaacaagcaggttgttctcatacatggccaagtattagcacagacagaaatcaatgtagaaaacaatttaagtggaaaataagttttaaggaaatgcagtgagttattgtaatagcaatggtcagtactgagcctgctcatttccaccttgtgccaaatactgaaagcacttaaaacagaaataaagtttcggagtaatcattcactccctgttcaccaaatacggaagtcttaagccagtgtttatgaaagatcaagccaaaaattataaataggaatgaaggccaaacatgttttcagcactgacgggaaactttgcagtcagtaaaagaacattagagtcagtcttttagaaaagggtttggaaaattattactgagaatacaaaagaaatcctgggagctaatcaaaagaggagacagttttgagagttaatcaggtgccaatgctaatagattatccaagtggcagagcaaagaaggtccagagtcacacaatcaatttttattcagcttgagttgctaatactgatgacaagtggttaacgactgcttcttccaagattcttaatgaaagacttctcttttctcaggtttattatgccactggattaaaaaaggtatttatttctgtactaagatcggtgacaggactacaccgagaacacgtccctcagtgtacattgccaatagatgagttttgtctatatcttgattgactaatcatttaatagatgtgagtgtaggttggcatgcaaattaagtaacttttggccaggcgcggtggctcacgcctgtaatcccggcactttgggaggccgaggtgggcggatcacaaggtcaggagatcgagaccctcctggcaaacacggtgaaaccccgtctctactaaaaatacaaaaaaaaaaaaaaactagccgggcgtggtggcgggcacctgtagtctcagctacttgggaggctgagacaggagaatggctgaacccgggaggcggagcttgcagtgagccgagatcgcgccactgcactccagcctgggcgacagagcgagactccgtctcaaaaaaaaaaagctctcatactagccttattgtttgcacttaggtatcactgagttgaacttgtagaggaaaatataacagaattacaaaagatttagacattgtagaaaaaatttggatttttattatataaaacaaacaatagattttgaggttttaagggaattttctgtttcgaaaaacagcattttaagtatagttttatttcatcttcataaattgtaaactttattttaaattctagtcattacaaaagactttaagtcaaatggcaaattgctttcctctatagccaatttaaaatgtttgaatggttatctatatatacatatgtattcaggttgtgttcatatacatattgttatatacatacataagcttcatacatatataacatataaagttcatatatgcatgtgtataattttatattctgatatgaatataaaattcatgaattgtagcacactgaaaacattagtttttgattagagaacattaaaatgattgtaaagtagaatctccagaatttccaaagtttgtaaattgaagacattcgaattttctaatttaaagatttgatcattccgagcgcctactaaacgaattataaagggaatggctttcctgaattacagtaatatggtagttttagctttgaacctgcctatctgggttcgaaaggtagttctgctacttattaacagtgtgcctctgtttcctcacctgtagaataatgataataatatcggtgtagctttgtcatgagctttggatgaatgttcccacttgaaccctggctctaacactaacttgctctatgggcttctgttaatcatttaattatgtggaatacaatttcctcaactttaaaacatagaatttggaaaagataatttctatgtgttccgccagttctaaaactctatcatctgcttctttattctaggtttttgtttgtttatttgtttctgcaggatgcagtttacagtccttgttggagtatgctctggaatcatacggcctggatttaaagtccagttttgccgcttactggctgagttttctcaatttatttacataacttttctttcctttagttttctcatctgtaaaataggtactaaaataataactatctcatagtgtcgttgtgaggactaaataagccattatctttatatggcatagaaagtgtctggccccaaatgagtaatcaacattgttattcctatcctgaaatctatgggctttcaatacgactatggaataaacccctaaaattgtgggcaaaattttatgagtgtgtatatatgagagtccacagtcatcagcagattctaaaagggctccatggtttgaaaaatgttggatgaaaaatatagacattattctggctcttatggatattaatgatctctgttttacttttttctggaacagtggcattaacagcaatagacctgtttttattatttttctttactttgcttttttttacatgtttatttaagagatctgctcttcatctctgtcaccattgtaccattctttttatggatatacacacagtaattggcactgaaagaggtataattatatacactgcagctatgccagagaaagccagggctccttatctggcctagggaataaataatgggttttcttcatattctcttagatattactcttcagccacctaggattgggcactatttttttgttgttgttagtttcttgtgcttccatatacacagatgcagtttcttgtcacccattatattgcaatgccctttctgaaaagagcccagcctttttctgtaatgtactttgacagtaagtattgacataatgtaatacagtaattggaactcagaaagatttgtttgctacctgactgcttaagatattttaatgccttaatcggacacatatttttaatgcacatttttctttagttagagcagcccatgtcatgaaggaaccactcaaatgtggaattgatggttttcacaggatataaaaaacatcatgccatacaagaaacaaatcactcctttctgcatagatacagtgaattcacagcttggaaaccagtattttcaaagcgtggtatgaaagtgtctgagaataaactctcagcagagatcagtagaaataaccagtaaccgctaaaagaggaacattattgattggcaaagtaatccaaaaaagagaaaagatgtgtgtgaacttaatactaaatttagacaagtattcattgattaggaaatcaaaattcaagataaagaaacatcttcagagattaaaagtagtctttcattgtttgagtaacctagctgaggagtcaaactaaaaccaatagattgtaattagtatgatgctttaggataaagttgaataaagagagcgagagagagacagagagacagatgcattatttaccctgatgtttatacaatgccaaggtcaattaatttataaattaaatttatgtttattagccaaattttagaaactagagaaaaagtgagtattaaaagctttaggatttaaagtttgatatatttcctttgcattttccttgcataattgtaattgcattgcacaagtagttagacaccttactttcttcatttaaaataacaggttttccaatgttgttcaaacacaatttaaatatctagaagcattgtcttctttgttcccataaaaattaccgttctgcttttttttggaaccttgaaaaatggtctcataatttttgctattaaaatagtcttgcaattactatcaatatagataaagcctccacccaaatgtgggattattaccttagaaaagagtctcaaaaattataatggatttaggtgaaaaatcatctccgtaagttttggtacatattttcaaattacttctcaaaaattccatattaaaccacattcctacctgtaatggatgaaaaggtctataacgttgcattgtaacctacattgaatacattaaatagaaatgtaattcatatgtaattcaatgtaattcacatatatgtctgtgtatgtctatctaaacatgaatgcatgtgtgtgtatatatatatatacatacatatacatatacacatacatacgtatgtatttaaagaatttagacttgggtcttagaatcaggctctccctgaatccttcaactgcgagatataaatataagggaatgttggcaatcatggtctgctacatgaggaacagcggaagccaatctgcaataaaaaagatagtttagagagaaggagatgtgacagagagtcctggaaggttttgattgcattttctgaggtgtactgcaatttgccctaacctgccttgagaaacattttaatccttagaataaacgtatcctttggaataaattccacatttgataaagatagttcaaatttggtataagttatttgtagccaagtgtcctaattaatactcaagtaataagtagtttactgcttaacagtagaattagttctatttcatataatttttccatctctcattcagatgggaagttgctctccttcctcttgtaaggtcatgatgctctatatctgcaaactcaagggagaaaaagtctcttaacttgaaactatacaggaaaaaaaaaaaaccctgatgtcatttctagtacttaattggtatttatctgccataaacacatgaagctgttttggtttgttcagttacccttgtctgcatagggccatttaaacccaaattggaattgtctctgggttactatcagtgataacaagaactttcaattcatgccaattataggaattcacaaacacagataggggtgaccaaggaatccaaccagaactttctgtttagtttcattagactcagacttaatgagaaaaaaaaatcattagcactgaaaaacttgtaagtcttgtttagtttcttgctgaaatttaaataatactgattgtgtctgtgatggaaactggtaaagaataaaatgaatatttaatttagtaaggtatacaaaacaaaacatgagagggagcatagctattcctaaatggaaaaataaattggtatactacaataggaagtatgatttccttttaatatgtttgttttatagaagttactaattgcagaaaccattttgatttaacatcatcaataaaatcaatgtgtgaacaatatcattacattcgaaagatgacatgtctaacaaaatggcactatcaatatatatgtatttaaagacagtctccctttaactttgctagacaccaaaagtttaaatgcacaatgccaagggcagttaagtgtcaaaatacaaatgtatcttaatattttatttaaggcttctattgttaaaaataatgcatctaacataataaagagggtatttgaaatttcatatttcaatatccccatggtttgccatagaagacaaatataaatacatgcatgaaattgtgattttattttcttggttactttttggttacagctcatcactttgcattagtgcatacctccaaacctccaataatctcatatgcatcattataaggagatgaaagggattaagaaataagtttaagtcagtgcatagaatattaaaagttcctttgcatctaatatgaatggaagtgattactattaatataaactcaataataaaataagcaaatgcctgcttttattttctcctaattaacaagtttaatcctttgcacttaatgttagttgtttgccccggagcccggcattggtagacatctcactgctcatgggccattcttgtcaccttgactcccagctcaactttgggatggatgtttcaaaccacctgcctcgatgtgttcaaactttgtgtgagagcatttttgaaggaatgtaattgagtatgaattatgtgacagtagatatgtgaattttgactgaaaagttttgtaaaacttgagaaatgaaccttttggctgggcacggtgactcacatctgtaatcccagcactctaggagctgaggtgggtgaatcacttgaggtcaggagttcgagaccagcttggccaacatggcgaaaccccgtctctactaaaaaacacaaaaattagccgggcatggtggcatgcacctgtaatcccagctactcgcaagtctcaggcaggagaatcgcatgaacccaggaggcagaagttgcagtgagccaagatcgcgtcactgcactccagcctgggtgacagagcgaggcttcgtctcaaaaaagaaaaaaaagaaaaatgaaattttttcttcaattttatagtaaatgaagaaaacatttcatttctccgaagactattttgattgacacccgtagcctatgggggtttcatattccctcttttccgttgttggagatatcatggtttaaatttttaggaagtatctcaatcattcataaaagtgtgagtattctaagttacttcaatgagatacaaaattttggagccctgcttccatgtttcaacttcaaaagtagaagtcagttcgaactccctggtgactgcacttgagaataaactatcagtcaataccacactccttatcttttctttttccttcctacgcccaccccaccccaccccaccaaacaaacaaacaaaacaaaaaggccaggacagcaggttctacacttttgaatgcaattttggacagtgtgccaaatctcagtttcaacatcacaaattaggtttcacaaatggattctgaatatacaaaatgcttttgagtcaccttttttcttcacctttaaattaaaagctctgaaatacaatgaagtgttttcttcagcttttcatgacttttcccattgggtgattcacagataacaggtcctcaatacatttttattaaattcaatttttaaaatatcacttatctactacggcctttctctaataaaaataagtattattcattgtttccatctaaagtaagggtaactgtaatgattaacatgtcgaatgtggatatcccaagagggtaaaatacttacgctttccatcataatcaagttcctcttctgcttaggatgtaaaaatgctatataagaacgttgctccacccaatgagaaaaagcagggtgatctataaaaacgtattattttttgagccatttatatagctgtggccacaaggcaacgaggtgagccaaagtacttcaatctcctccaaggagagactggatacatgaaaggtttacctttggcagggaactggaggaagaagtagtcatcgtaggagcaggaaaaagaaaatagctccaattgtaaggcattcttaaaagtcaggtgtgggctggtatgacatttcagcatccttggaaatgcagaccgaaggagtctgcactcattctggaattcttttccacaaacttctattgggaacttgcaaaaaagtaaggcgtaggacaagagataggaagaagctcccctcagtgacacacaaacatgaagtcaaacccattttccagaccctcctcttctaaaaggcgtaagatttaaggaaagatactaaactgaaggaaagatactaaactctaccacccatgggacccgcctgttcagaggggttggggaaggtagaagccactgagagagggtcaagataccctctttggaagagcagtatgataacctctttggcccaggattctgcaccaataaaaacagaatgatctgttaccactaggggagagacaggcatataaggcttgctgaaaactgaggatggaacaagaagatagaaatccctttaggaccgcagacactattacattaagcacgggatagcagcagcccatcagtggaggtctttgaagactgtagtgttctgaaggttgctacagcaacaacaacccccgcccctccaaaccagctcaatactaacaccactgactcaaaccccatactagcagtatgacagaaaaaaagctatacctatttccaagattaaacatatttacctcattctctatttttcttctatacatgacatctaacattcactaaaaagaaaatgagacttgcaaaaaataaataaaactaagcaaaatacacccattatcaagaagtaaagccatcaacataaccagactaagagataacctatatgcttgaactaacagacaaggactttaaaatatctctgactgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagataagaaaatgctacttatgtgctcaggtttacacaactcttagatgtctctgactacaaagtctttgttctttttaatgtacctctatgcctctcatactttaaaattgaaataaattaatctactgctccaaatgatcaattttccatggaaaaaaaagagaacttttgtaattgtaacaacctctgctatatgactaaacactgagccatgaggtgggctgccaggtaaattggaaggcttcatctaaaaagtacaagactgtgaggcatattcccttctcaacagcctaggatgattggatctacccattctgtcacattttcaatatataattcctgttcaaactttctattaatatatcatttcaagtttcattgatagtcctaaaatgcaacacaaaagacgagcagatgatttcagccattccaatttgcagccttttgtagaggggcatcaatagattttactgtacttgcataaagccctagttgttcttttcctattctatcatttctggattggcgaatgggataaaatgttcaggaaagaaaaaacaaatctcaacacaaacgtgaatgtcattgaaagctaaaaaagtaaacaaagttaatgatcacacccgtaagtgctactgatttttcattgaactcagaggagaaagttactggattcccaaaagtaagtgaagggtatatgtttgctaaatgcattcacagcctgttgctctaattatttgaggttttttatgtgttgttgttttagctgttgtttgtgttttttattctttctgcatttttcttctactgtacagttgttattcatgctatgagttatctaaagtttacattaataatcaaattccttgcaccatcccaactctgaaacacacaacttggatggagattaagactcattcaggactcaggcagacatccttagtacccagaaccacaacacagcacacacgaatgcatggttctataattattttatggagcatctatgaatttgctatgcaccggaccctgggaagtcaatgtacagtggtcaacaaaaacaattcaattgtattaatatttagaagccacaaaatgcaaatatattcttttttaatttgaagcttgttattcttctgcacaatctatagctcctattagaatcattaaagtacattcagcagcagtaacaaacgaacagggaaaatgtgaacatgacaaaaggctgccagagtaacacgggtgacaaatgtgggaacattttagaattcccaatttcccactctaataaaataatatgaacaaaaaggctttttttagtagcttcaactgaaactatcacctgatctatttcttaaaatcctcacgaaggtttcactgaaccattagaggtttgggcagtcaaacaaattaaacatgaaccaatctttttagaatgactactgaagtgctcagtatttccagccttccagttaccacagtgaaagaaacaaacaggtacttgtcaggtttataagggaatgatctattttctgcccttttttgcctactctttaaggaaaacacacacacatatgcatgcaagcatacacgcatgcacaagcagaacacaaatttagaagctatagagaaaataaatagaaaacaaagaagttttgacaaaaccaaactgtctttacttttagattataaaaacaatcaactcttttttttattattatactttaggttttagggtacatgtgcacaacgtgcaggtttattacatatgtatacatgtgccatgttggtgtgctgcacccattaactcgtcatttaacattaggtatatctcctaatgctatccctcccccctccccccaccccacaacaggccccggtgtgtgagggaattagaattttgtaattcatttgggtagaggagcaaaaggtatatattaggctcaacttttcagtcggtgatgagagacaaatggcctgccatccctgccctctctcacctaccccagttaatctaaatctgcaaaacgaaaggagcttccactaggccagaggggctgcaggatgggaaaacaatcagaatggaacactttcatgggcgttcctacagaccaatttgcttccagtcagcccatttaatttcatatttatgattgtttaaaagagagagcccaggcgcagtggctcatgcctgtaatcccagtactttgggaagccgaggcaggtggatcacttgaggtcaggagttcaagaccagcctggccaacgtggtgaaaccccgtctctactaaaaatacaaaaattagccgggcgtggtggtgcatgcctgtaatcccagctactagggaggcttaggcaggagaatcacttgaacccgggaggaggaggttgcagtgagctgagatcgcaccactgtactccagcctgggtgacagagcaagagtcagtctcaaaaagaaagcaaggagggaatgggacaattcataaaagcaagccccagcagttctagttaactgtgaactgaaccagtaagatgcacattgatttaacttcggaaataatttatgtgctggtttcttaaatgactgctacatattgccttcttacctgacgatggagtgcagaatatggggacaaaaataagagcaattccaaggaaatgctttatgcccgagtgctaattcagaaccatactgaaaaaggagatgcaagagaatgctcagcgtagattctaggccatccttaaacaatccagagctgaagagccgtattcagagataaatttattctgcgttcaatgtttcttgacctacttctcgtaaggaaaattctgcctgaataccagaaggaattcatttttcactttagcttgaaatttaccttaagataaaacacaatagttgtataaaaatatgccttatttggttatgcatataaagcagacccaagaggatttggggtaaaatatttcataagttgtactatgcatgaatataaaaaatgagaaacaaaaggatagttagtaaaaggctgttcagtcccaaataaaggagtaattgttgatatgctaaataaaaggggggtggggaaagtcctttttttacaagggaatgtgaggaagggaactcacatttgttgaggctgtattttgcatttaatcctcacaactaggctgagaacaaacattaggcattttatttcccatttacagattgtaaacctgaggcaataggattagttgcctgtgataacaattcacatgttgagaatcataatattataggcctccaccacctaacaatgccatcttcagaactacacacacacaggtgcgtacacacacacacacacacacacacaagtatttcgtgagattgtaaccacattcttaagttccatcctttgcaagtaaggtaagttaggcactgtttcctcactgccttagggttgtttataaatacagagctcttgaattacaaaatcaactcttgatttcactgacagaggtcaactgcttttagtgtaagtgaaccatgattctggcataaacagatatagaagaatcctgtttaaaagtttttacctgctctaggtgcctaccaagagaagaagagggggaagttgagagagttacagataagtgagagctagaagccgtgtgggggtgtggggagggtcctgaccctctgacacacacacacacaccttttcaaataagaggaacattataatgtcctcttagggaaccaaagtcctaaagaagagaaggaggttctggagctgctgaaaaatagtgcccaaccagagcaaagggactgggcatgtagattagcctcacaggggtctgagcatctcatcaggtttgtgataagcagctaacatgtgtcggtgcttgagaaggtcatggaagttaggaggagcaagctggcagtctttcaagggtgtggtaatcaggacacagacaccccaaatcctggaggcagaataggcagttcaactaagggcgggatgcaggtactggttcacttcagccaatgcctgcatgcaaagatcttcttccccacagaccacattggatgtcacatctctgtgtgtccttgacctagaatcagaagttggccctgatgccatgaagctaagtaatactcctgtgttattccaatcctagagtggaggctagagtcctaacaactcctgaatgtgaccggtagacctgaaaagtcactgaattttattaagatttcctgagaatggtatattaagaaacctgttaaattaaaagaggaaccaaaatagaaatttaatttagctatagaaaaattaataaaataccatttttagcccacttaaatttgtgtgatactgaaatttttttttcctgctacagatgtataatttagtgcaaaggtgtagggcccaaggcttcactgtgaggaatgtaaatgtgctccccaaaataatttatgattttgactaatgtctgcacaaaatactatagtccataacaggtttcaaatcttataacaactattaatactatcaacatgtagaaataagaaaactgaggcttagagtggttggactctatccattgattgcccaggataacatcaagtgactgactgggggctcaaaattgttctcctgattgtaaatatcaatcctgtttcctatacttgtccatatacttcctgatgcctatttggtgctcaataacttttagattgagtaaaagaatgaacaaaaacatgtatttatttagtgcccggaaggggcatagcaaataattgatatcctttcctatctcacatagcattcagtacagcaaagtaagcaaaattgaggagggaattttaataatgttgaacatctacaaattgctagacactgagatttttatgcactttttaagtttaatcttcgtgttaatccacattacatatgaggaaatggagagagaatatagtttgtcaaggtaatggccatagtccatataatttgagtgcttactatgtgccacctactaaacactttaaacacatgaacatacttcattttcacagaccttgtaagagaggtacttctcttgaccctattgtatggataggaaacaaagcttagcgaggttaagtaactgcccaagttcatatagctactttgcagtagatgagcacaaattgaaactcatgcttctctaactccattattaacccaatagcaggtgctgaaaatcactgatcgtgttgctgacaaaggagagtaaacaatagccacataataatactatctaagggaacattactgatgtacctagattttttaaactttcttttatttatgaaaataaaaatgaatatattcgattgtattttcattcttccctctgtttgtgccactttaaacactggtgcctcccttctctttgacccaaatactcaaaacaggtcacacatttaaatatggcaagccctccagccctgcaaatgatggactataaaatttgtttgtactactggcgatttttttttaaaaaagcttatgcacacctactttcatatttttaggttggacagtaccttagaaataaaaacaaaaattaaaacagatctttatcttttaaaaaatctattttccaaaaggaaacaaatgaattatttttgtcttattattaccatatagcttaaaaatcaattacctgaaatcattatcattcaaatctttaaaacaaggcacttaaatgtttaatcttttttaaaaacttagccaatgcaaaactgctttcctccaaaacgccctcagaattacctgcttctcctgcactcttagtatccccaagttattggcagtgaataaaagtgtaaaggaaatgaatcttgcaattctctgtgaatttcattccaaaaaagaattttaggcattttgatgaagcgatgtagggattagttttaaatagggatctctgatttgtgtattattttcacaatttgtaaacttactttcttccaaaagtgatttgaaataaatattctgaaacactgaagatcaatggaagctaagaattagaaatgcttatacaaatctattaaacctaactgtatatatgcatataatatttttgttaagaaacatagaattctttagaataattcaattttatataattatggatacagacacatagattcacattgtaatgtttattcagattttgtgtttatttgttgattgttcaggcaaacggaaactgcatttggtgtcaacagttgcatttctttatatttatattagctggttagctgtgctggcagaactaaaggaaacctgtccatagagccttacgtagtcgtaactacaacacaatcatgtgtcacaaatttatagcacagcagacctttacactgaaaattgtttagagaaagaaaaattcgactgggagcggtggctcacacttgtaatcccagcactttgggaggccgaggcgggtggatcacctgaggtcaggagttcaagaccagcgtgcccaacatggtgaaatcccgtctctactaaaaatacaagaaaaattagctgggcatggtggcatgcacctgtagtcctagctattcgggaggctgagggcaggagaatcgcttgaacccgggaggtggaggttgcagtgagccgagatcatgctactgcactccagcctggctgacagagcgagactccccatctaaaaaaaaaaaaaaaaaaaaaaaaggagagagagagaaaggaaaacttgaaaaatgaatgagaactggtaaacaactgcagggaaagtaattaccacactcttcatatggcaaactaaagaaagggggcaccgcaagaaaagtattgccagagcttgaagggcagaatgtgtaattaggatgtgatatctggcagtggtgattccaatcattggggattaaaactgtatctcaacttgtgctctttctgttgctttagggccagtgtattcactcaatcttccatgatatctatatggactcactgaacctcagatcttaacttcagttgagcagaactagtcttctctctctcagaccaaggaaggcataacttgtgttccatgaagcctactgtgtcaagtctgccaaatgaaactttaaatatgtaggcattgtctacttagcctgaacactaaaaagagtcctttctacagttcccaaggatttgtttggttgcaatgtttctaaagtcagtacagaaacttccctgaaaatggagctccaaacttatcacgattttcatcctggaatgtatttaggtttgtatccctcgacgtgcaccactcaattgacgtcacatactttttacctgaaatttatttcagtttctcagaagactgtatatttccccagttacagattttactattccttaaatatggtggctgccactttcttaacctacagtattaatggcagaaatgcttagatttataaaaggcaaacatggggaaaagagagacaatattaaattcaagtctctcgaaaggaaaggaaaagataatgaaaaagcaatgtaaaaaatgagagataggtggggcaggtttaagatgccattgaatctctgcatagactgcctttttttttgctctaaatactaaacttgcctaaattaggccacctccctccagagaacaaaaggaaacttggccactatggaatagtaccaaagtgaatttttagaagctattattacccactcataatctatatttttgaaaattaatatatatgtatatttgtaattatcaatattaatacgaagcaatagggtcaacatgaacttggatacttctgttaagttcacttaaatattgaactaatctaatcacttctcattttttctttaaccaaatatgtaaattcaatataattgacttagttctcaaattggttcaataaagtgttcccacagtatttgcaaatatattcgtctttagaatattcctccttaacctttttaagtagaaattaaaatagaaatattaaaacgtgtatttaaaagtggtcttttctcttaacagacatttactttttcttacatgaattggtttagtttttttttccagcactgaaaccattccaaaaaaaactgtagaaaagagtgaatatttattctattggatgtttgttatgtttgcataataactaattagtgaattgaggccaactttgatcaaaatgtttgctctgaatagatatttgctaataaataattttttcatgtgataagtgtgtaataataagttctctatgctgccttgctttgatagaatattcagacaacatttataaatgactaattcaaggaattaaaaggtcttaagtgccccagaatgtagaaatggaataaacatgtggtagtggtgagggtgggctagaaatgattaaactagattttttttaaaaaaagaagcaaaaataccgctggaaaaaatgcacgcagaataaatgtcattatgaaatattctgaacgtgtgtacttgattttccttcatcacggcttcattttgagacgtccaggtcaaccactgtcaaccaatcaatctctagcctctttgagcagagatcaagggcaacagcagagccttaatgatttcaacctctagccttcaagggcacagattacagggactgaaagtaaatcagtccatcacaaggcacttcagcccatagcccatgacaaagcttgattagaatggaaaagtgttaagccatcaaaaacaagacacagctataaggaaagaggaaatataaggctaatgaattttagtgttcataacaagataaaaatgtgtttctcaatacctgtgtagccatttagaaatctaaagagcaagaagaaaattatgatagaacattctgagcaatttcttcctcttttctcaagagcagaattgagatagacttagatgtcaagtctacccattcttctaggccgttctcagacccattttcaaaaaaacaataaatccaaaagccaaaagcaataaacttgtttaaatactgaagttcacatggtgctcatgttttcagaaatccacttacactttacacccataatgtaagtaacgtaccctttaaatatttaactgctcactaatgtttttatttgcatatcatttctttttaaaactagataacacacacttttttagcagatatctttggatcttcactatctcaactgacttttctttttttttttttttttgagactgaatctccctctatcgcccaggctggagtgcagtgtttcaatctcggctcactgcaacctcctcctcctgggtccaagcgattcttctgcctcagcctcctaagtagctgggattagaggcacccaccaccacgcctggctaattgttgtatttttagtagagaaggggtttcatcacgttggctaggctggtctcaaactcctgtcttcaagtgatccactggcctctaactcccgaagtgctgggattacaggagtgagcccctgcgcctggcctcaaccgacttttttagaccacaggtaaatgttagttttacttaatgattgtaattattttgatatactctatatggaaaataaggaaagtattttttcccttttaaaataaggaaaatatataattacgctctatttttttttttttttttttgagacggagaccggctctgttccccaggctggaagttcagtggcacgatctcaactcactgcaacctccgcttcctgggttcaagcaactctcctgcctcagcctcccaagaagttgggactacaggcaagtgccaccacgcccagctaatttttgtatttttagtagagacggggttttaccatgttggccaggccagtctcgaactcctgacctcaggtgatctgcccgcctcggcctcccaaagtgctgggattacaagtgtgagtcaccgcgcccgacctaaatatcctttaaatctagtgtatctatgtgactataatgatgagaagtcaggatgccttccctacagctaaacaaagacttttctgaaatgtatatttggagacccagaatttcaccttatttgaatgcaaaacacttagaggaaataaatcttaatagaaatgatttttacagcatttcgaacacaagaattgtagtttaaaatattgttctttaaagctataagtaaaccaatgtttccaaactgttttttctagagcaaaatttcctagaaccaaaataatcttgaaattttagattaaacaaagcaaaacagattaaatcacctccaagtttctcagaatcttcaacatacaaatggctgttaatatctcaaaaaggaataaaaactgtttttccaaatatatacgagaatgactttttttctcccctagaattagctattgatgccaagctcagtgtttctcatatagtttaaaacacacggaagtaaatttgctgttcccttataaacatatcctgataatatggaaacatttattcaactaactaataacaaaacaggcaacaaattaaaactgattcaaaggggaattcaagggactgaacacacatagtcacagaaagaaaaagaagctagaacaagattgctaagttagaaacaaaacagattaacatcaaaaagtgcaataaaattatatattttgagggtgccagaaagatattacttgtctctctactgaacaaaaatgtgtacatttatgtaaaatttctcagaatctaagccctaatcaatagtaaatactatagggtgactatagtcaataataacttacttgtacatttttaaataactaagagtataactggattgtttgtaacacaaaggataaatgcttaaggtaatagatgccccatttattctgatgtgataactatgcattgtatgtctgtatcaaaatatctcatgtgcttccaaattatatgcacctactatgtacccacaaaaaaattatcttttaagttagtactaagttatacaaagacgcatgtccctaacaaattaaactatctgtcggtagatcttttagacaatactttttagtatgataataaaagaacatctacttgttcttttgccttatttccaagttttagagtttaacaagcttgaatgtgtcataattactcatttaattactcacgtaattacttaagtgtcaggcattgtgctggggactagggagatgatagggaactggataaatgcccatactttttagaagcttactaatgagggataatgacatgtaaacaggaaattgcaaagtggtttgatgtatgttaaaacatagttactgtgggccgggcgcggtggctcatgcctgtaatcccataactttgggaggctgaggcgggcggatcacgaggtcaggagttcgagaccagcctggccaatatggtgaaactccgtctctactaaaaaaatacaaaaattagccgggcatggtggcacgcacctgtagtcccagctactcgggaggctgagacagaagaatcgcttgaactcgggaggcggaggttgcagtgagccgagatcacaccactgcactccagcctgggtgacagagcaagactccatctcaaaaaaagaaaagaaagaaagaaaacaaaaagaaaaaaaaatagttactgtgggatgttgagatgacacacaagagatattcctcctgtaacgtcaattctaggtatgttccaaaaaggagacatcacctaaatgataaactggagttagctgggtaaaaagttgaggtgggagatgacatttccagaagaataacagaagctagaatagtgacttgtatgacatgattagtacgtacaatgtcgttcttgagggatgggtgggttcggtgggtgggaaggggtgaatgtaaagagatagtgcagaggccaattaatggagagattggtagagcatcttatagaattcagatttcacttttggggcaatgagaatttggcataatgagtagcattatctgacttacattttaggaaaactctttttgataacaattgggaaagtggatttgggaagtttgaagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaaggttttctagggggaagatgacacaatcgaatatgctttttaaaacattctggctgcatgtggaaaactgaatcacaggggtgggggaaattgaacatctgttttaggggaactgcaacaatcctggcaaaacatgatggctgatgccaaggtaatgttagaacagtgatctcgagggagaatgcaagaatgatacccccaaacctgagaagtttggcacatgatgtctttcaatgagctagagaaggaggaagaattgcttagaaggcagtttttgatctcatatatactgattttgaattaactatgtgacatacatgagcataactgatgggcagggggataggtctctagctcaaaagaatgattttggttggatataaaaatctgagggtcatggttaagagttgttattgctatggattttgatgagatcaagaaaaatatgttgattgagcattaagattgaagctcaacgttaaaagagatttacgataggagagcaaccctccaagaaaatgataaagttgccctgagacaggaaaactagaatagtggaatatcttagaagccagggaagaagagtttttccaataggaaggaccgatcaacaatcaatactacagagtggtaagatgaggcctgatgtgacttgggccgtgacaaaatcaatttcagttgaaggatgtggaagcagccggattattggtgtttgaggtagctacgtgagtaaggaagtagatacaatgagcatagaaattgttaaagaagtttagcttcaggagtggaaaataacaagtcggtaggagattaaaaactaatagcagaatgtcctatttgttactacaggcaacactgtattgcaagttaaaataaattagttaaacctgacacaaatgcctgaacgcaagaaaaaaaattaaagggtttcttcaaccagacatttgtattttaagcattttattttggcaatcaattggggaaatgagatattttctcctcaaaggtaatgctgtagcagttataattgtattccaggacttgcgggctactattacaaatactcatggaaattaatgaatttttatccccctggctctggaggagtggctgaaagcaccgtgttttatagtctgacaaatttgggttctattcccagtatctctggataccagctatatgaccttgaacaaaatactgagcctctttcaaagcctcagttttctcatttgtaaacaaagcagtaacaatagctcttttatagaatcatggagaagaataaataaagtaatgaatgtattgtctactacactgtctctcaacctagagactatatcaaaatcccctgaagaacttcttataatacctctcccagaattcattatctagtaggtctccgcacagcccgagaatttacatttcttacaaatttccaggtgatattgcgggtctgaaacatactttgagaaccacagctttagcacatagacagtcacataacaaaaaccaatgaatgtaaatattagcatttctttgatggagacagccccaggctgcctacagcaagatgttcccttaggttcctgaaaatagaaagtcccgcatggtcctcatcaaagtccgctggattccttcaatacctcttcctcttttctcacatgggcattaacatccccactcctctaccttctaactcaattatctgacccctgcgctcttttttttttctttttcttttcttttttcttttcttttcgagacggagttttgctctctttgcccaggctggagtgtagtggcacgatctcggctcactgcaaccactgtctccagggttcaagcgattctcctgcctcagcctcccaagtagctgggactacaggcatgcgccaccatgcccggctaattttttgtatttttagtagagacggggttttaccatgtttgccaggctggtctctaactcctgacctcagatgatccgtctgcctcagcctcccaaagtgctgggattacaggtgtgagccaccgcgccccggcccccctgcgctttttataaattcattcattcattcgttcgttcattcattcaataaactctgctacagtattcagagactcttttctgccatatttgctttgatctagttaacacttaatgagtttatataccataatatcccttttacagtatcctgtaacgaatctctttatcatttctagcttatatcatggagtctgtgacagacaacaagattgcctctgaaccatgccctctactgatgtgggtattattatactgatgagatttcttctttctcgttctctgttatgaaaaagcaagctcatggcccacggggctcataaaaaatgtactaaaggctgagagcaatggcaactaatgatatacgtgtaagtacatattgatcaaattagagatgattttttttttcacagctcagtgatgtgtctaacaatagtattctgggaaattccatatatacataatataagccatggctttattcagatagaacaaatgccagataatattgttaggagcttctacaatagcaaaattcaaaatcacattatcattttaaaacacataaaatggctcactttttttttcttcagtgcctgtccatcttgtttagaaaagacttgattaaagccacatccactgataggcaatggaagttagattagatacttgtgtatccgatactgtttaaaagactggttctgttttataatttgaattaaatggtaactaatctttttttttgtaggagcttgggctaggcaaagtaaggaataaagaaataaagttacattttctatgactagaggtattttagaagaagttgaatgcgtacttaataaaatgtgtgttctatggagattctacgcatgcatagaaaactaggtgaaataaaaattctgcacatttctgtaagcaagtatcaaggaaaaagagttctgaacaattgcagcaccctgtaagtctccttcatgctctttcccaattcacactatattcccaccagcctctcaggaagaaactgctctgctgacctgaatcattatagataactttggccagttctcaaacttcatatagatggaatcacacagtaaatgttcatcttctagtcaacattgtgtttatgaagttcgttcatattcttccaagtagcaggtttttattactatataatattccacggatatacccaatttttgttttttgtttgttttttgtttttgtttttgagacaaagtctcgctctgtcacccaggctgaagtgcagtggcatgatctcagctcactacaacctctgcctcctgggttcaagcgattctcctgccttagcctcctgagtagctgggattacaggcgcctgccaccacacacggctaattttttgtatttttagtagagacagggtttcactatgttgaccaggctggtctctgactcctgatctcaagtgatccgccctcctgggcctcccaaagtgctaggattacaggcgtgagccacctcgcccagtctataccgcatttttaattctaattctgagggacacaagttatatcaggttctgctattatgcaaaatgttgctattaactaccttgtgcatgctattttggtggacttaatttctccccttttttgagacagggtctgactctgtcccaggcaggagtgtagtggtgcaatcacggctccctgcagcctcaacttcctgggctcaagccattctctcatctcagcctctggagtagctgggactacaggtgcatgccaccatgtcaggctaattttgattattattattttattttttttttttgtagagatgaggtcaaactatgttgcccaggatagtctaaaactcctggcttcaagtgaccctcccactttggcctcccaaagtgctgggattacaggcatgatccactacacctggcctactaatttcttttgaacacatacatatgagaggaattgctggctcataaggaaggcataaatttagatttagtagatattggcaaatattaatttacacttaaaccagcaatatttgagagctccagctgaggcaccaattctccccaatacttgatattgtcttattatattttaaccattcggatgcatatataggggtattcaaaattctttgattactaatgaagttaggcacctattcaaatgttttttaccatctttgtcctcttttatgaagtgcctgttcaaatattttgccaacttttaaaaaatgggttgtctttttattgatatgtatgagtttattatatattatggatacaagttttctaatcagatatacgtcttgtgaatatttttctcccagtccatgacttttcttttcactgttattagtgtattataatagatagaattcttagttttaatgaagctcaatttatcagtgtttgactttgtacttagtgcttgttcggtcctaattatgaaatctttgcttagcctgtatctcactcgtagattattttacttatgactggagattgcccaccagatgtaaccacttacacactaatggtcacagccatattctccttgactatgtttacttaatcaccattggcagagactatgtctcgtctaatattcttttatcccttattcagagactctcatattattgtgactgtaaattttcttagctaaaataatttccctctatctctctctgtctcactttctttctctctctctctctctctctccaactcccaaagatatataagtcggatttattgggcacagctaccaggaaaaggggttcaagaagggttacagagcaaatgaataatcttttgctagggctgaggagtccaactcatggcctcgatataatttttgagaatggaagctgggaatagaagatgtcagggaaccctggggttgttaatagtattgaaacaacctaccttgcagtacttttgagagagatataaaaccatcaccctgttctgaagctcgagccctagcttattattttccctttatcaattcacaaataaaagcaatgaatttcctacaaatacttcttcttggttttgaaggtatgttatagaatagaaaaagtcttacaaaggtgtattttcacatagtggttggtgatggtggacagaaatttttaaaaatcatatgtacccttcatttcatatttttataacaaaatgacaatttaatcaatgtattaaattttcaaaagaaaatgcaaatatctgttctacatagattgaagaccaagaatttctgccagtgatacccagccaagattagttttcagttagtctttttataccatctttcaaaacaaatggtaatgtgcgatccttatactgttaaagaaaaaattattcaatgtcacttgctgaatcacggtaaggcaggctttattcaagaccatctcaataggtatagggaccgtgaaaatagggtcttgcagtaggggagagagattgagctcaatttgaatacagcacaggcaaatgggaattttataaccaaggaacagggtaggggtcagtggatggaaaattattaagaggaagcatcatgggtaagggagactcctgctgaaaatagtccagtcatcccctggaggatggtggatgatgaggaacatgatcagatatccaggataatcaaataccaaggatgagtgttttctggctaaactgatctggcctgctaaaactaaattttaggagaatgtgcacagactgggctatgagaaggttgggaagcctgaataaattttggccgagcaaataatctttgtcagtactaacatagttaataaacagagagtaccccagtaattcatttatgaaaatgtgtttcaaaaaattccagtctcgaccaggcgtggtggctcacgcctgtaatcgctgcactttaggaggcagaggcaggtggatcacctgaggtctagagttcgagaccagcctgaccaacatagtgaaacccctttctctactaaaaatacaaaaaaaattagccgggcgtggtggcatgcacttgtaatcccagctaaccgggaggctgaagcaggagaatcgcttgaacctgggaggcagaggttgcagtgagccaagatcatgccactgcattccagcctgggcaataagagtgaaacttcatttcaaaaaaaaaaaaaaaaaaatccaatctctttgaaagttatgtatcacttgacaaaaacatttcctttgtgacgtaggttcagaaacattgggttaaactaagttaaacaatttttttaactacaaaacatttcagggttgagttgtgactcgctaaagaaggaaatgaaattatcacattttaacaatttgtttttcattcaacatcttacgggatcaatgttctttacaatttccatttggaaatgctgttctagactcatccgttatataaattatacatttaagaggatgttggttctaaatactttaacttgctatcaaggcagaaatttaaaagcaaatttgctcttgttacgttattctcttttatatccaagagaaaaagaatgttaagttgaaagttattttgctcagggacacttacaaagatatatacacattcagtagacacttgcatgacattacatttgaaattggatatatcttttagctttttatacacagatcatagtatgcagattttaagtggtggaaaatgaatcttttaacattcaaagtgatgagctttggagaaggctgttttaatctgttatactgcaggtgtaactcctggtacacttgtaggttagtagtgatattgtaggcatattcgatggatcaatatatatggagtacttgatattcagatattcagttctccccgatgccttaatctgggtgttgtttttgcagtggttaggaggaaggagaggaggtgccaagattcagacactgcagaagaggattatataagcagaaataattccatgatgcggttttgtacctgtttactacaaatcaaaggtggctgacacaactttgtccccaggaattctataatggttagacgatagctgtaaatacgctcctgtgttccttccagaggtgtgtgggaaaccctgagaatggggtgtgcatttgcccctagttaagggtcaacgaaatctaaggcagaattcagctacaggtttagagctatagtctctttagagttccaggtgtcccttttacttaaaactctttttttccctgacattttaaatataagtttccctattcactttgcaaagcttagttaatactgatatgtaacaaaaattattcgctacacttgagcatgtctcttctccataaagatccagctttagatagcaactcttctcatagatctgtaagtattgtgagaagataattaaaagtttgattattgtccatataaatagacggtaagaaaatacacattttcagtattgaataaagactttccttcttctcagcagaagttgattgtattccagaaaaggaaagaatccttcctttcataagggcaaattaaaatgcaggaactctgaatttgggagtctgtttttcaagatgaataatcatctttggcaataggattcaaatggcacaacagaaggaattgaattgatattgaataatctgaattcttgatccaacctctatttttgaatatgtacatttaagatcactttgtgcatttaactctcattatgcataattgcataactggacaacaatatttgtttcttcctggaattcaaggagtttattctacaatttttgtttttatttatttatctatttatttttgaaagatggagtctcgttctgttgcccaggctggagtgcagtggtgtgatcttggctcactgcaacctccacctcccgagttcaagcaattctcctgcctcagcctcccgagtagctgggatcacaggcgtgcgccactacgcctggctggtttttgtatttttagtagagatggggtttcaccacgttggccaggctggtcttgaactcctggcctccggtgatccacccgcctcggcctcccaaagtgctgggataacaggcgtgcgccattgagcctggctattctacaatttttagaaaggtagcaacttctttccccacatgacattaagttttttataatactaaatatgaagctttaatgcaccaaacatacttgcaatcatcaataaacatatgacatatctctactaacaagcagattggaaattatggcatcaattcaccatctgtgccacacagactctagttttgaaactcttatttgaaacagaaagttatatatgagcataagaggacactgcacatggagttcttctaactttatgtgtaaatttctacttaatagaatatatactgttataagctgcttcacttattgttaaacctatatacatatacattaataaaaagtcattaatattgacctacaaataatttgagttttaaaaaattattattactgtacttcatttttggaacaggaatcaaattataataaaactagtagcacagaaacagacaagattactttggttaccagagactctgccaaattttcaatgataatttacatatgaaaaaaatagaagaaaaagtagaaaatgttaccatggcagtaaaatatgcatgtatttgaggatgatattcaacaggacttacctgcaacaaatataaaaagggaagtggaaaaattcactaaatcccttaaaatgttaagtactgagggtggaaagtaagatagataataattataatttttcctagaatgagggtaaggctcgagttatgaaaacactaacaccgtcagagtaagtcttaagggagaaccacttctggaattccctggttttgctccccggctgatgtacagaacatatgtctctagaagaataatcaaaggcattacaaagaaccctctcactaattgctgatagttacagtacagtcctagacacccatagaggcagttctttgcccctactacacatcagaaccacctagagagccataaaatattacctaagcccataccccaccccagaccaactgaatcactatctctatgccggggcttgggcatatggttgaaaattgcagtcctagatgacctgctacaatacacacacacacaaacacattttcaacttcatgtactctcatactttccacttcacgcactagcacttgttccctgtaccttcctaagtccacttagaaaatcagattttacatttttaattttttcgtgtgtgcattttaatgaaagagtatcactaagataaaatgtgacagtaggcaaccaatttctttcttcacagagcattgaaaatagacataattgattgccttagattcatgcccatatatacatatatatgcacatatatacttcaaactcattttgatagggcacagtagtgatttcctggtgtaataacaatccgttcatttttcatgtaacattgtctatatgattttattatactttttatacatagaatgaaatatttgttaataaatgaagaactaagggcactcactctatagcaaaaatgccacctctactagtaagaaaaagaaataaacattttctattattgcggcaactttctaaaaggaaaaaaaaacacaggaagactatcacataatgaaatcctttaattgttacttctttctctatctcactctcttttgtttcatccaagaaaactatttaactattatatagtgatatgtaattagagtctttcaattaaaattgttaagctacagattgttgacaccaccgaatatacttgattaaaataagtatagatgtaaacaaatgtaaacagaattgcacttaaatgatattcattatttagttcatttatttaaaatgcattgatggccagacgcggtggctcatgcctgtaatcccaacactttgggaggctgaggtgggtggatcacctgaagtcaggagttcaagaccagtctggccaacatggcaaaaccccatctctactaaaaacacaaaaattagccgggcatggtggcaagtgcctgtagtcccagctacttgggagactgaggtgggagaattgcttgaacttcagaggcggaggttgcagtgagccaagatcgcgccactgcacttcagcctcggggtcagagagagacttcatctcagaaaaaaataataataaaataaaataaaataaaatgtatggaatggccaaccaccattctacgaagtaagaactgaaagtctaataagcaaaggtctctacttctcagaagctctgttggatgatacaggtttgtgtacaaatattacattaacatggaaaaagtgctaacatgcagtagaggaggcataaacttgctcgattaggtttggtggttggaggttttacaaaagagatgatgaggcaaattggtgtttacctacacttgacagcccccacccatagttagtataaaatgtaattataattttgtgtatacagtacttgaaaaattattacagccaatcacaatagtggatataaaaattccaagtctatttacaaggaaaacattctggccaaatatgaccataaatatttgtgcttacaatacctagaaatttcaaatgtttgatatgttaaatatttttatttgtagagttcttcactttcaaatatagattacttttaatgagatagaaacaattatcagtttgattcattaagggacaatatcactttacagaaatttacatgtatttattaacatgtgaagcactttagtagataaaaaggacatttttgtatcacttaaaacattaggatgaaattatgaaatgtacatgctgcctactggcaccaaagattataagccggtctcacaattggcttttcattatataaagaacacccattatatgcttggaattcctatgccagcaggcatacagcaaatgctggaagcccattgttcataactttacttcttgccaagcatttcagttatattttctttggttatataaagggccagagctattttaagtgaaagaggtagccatcctcatctcactatatgacagatgtcatattacaatgccctacataatagtatgcaagggcaatgctacctccttcgacctggtgtaaaattccttagaattacaactgtgtgtttagacaataaaaccgaaggatttgcctcaaatatcaaaactaagtgcaaatgggcaatgctatatagatgagcaggaaacatttctcactctcctctaagtgaatgctaatatgatttcatgaattgacacaactaaattttgctttataagaacatacatagccaaaggatttaaaaaaaaaaaaaaccaccttaaaacaagttacagagggttaaacggaagcaaaagtaggtagctaagtattaggaagggtggaataatgtctaggaaacgagagtaataaggccaggtgcagtggctcatgcctataatcctagcactttgggaggccgaggcgggcagatcacttgaggtcaggagttcaaaaccaacctggccaatgtgatgaaaccgcgtctctactaaaataaaaattagccaggcctggtggtgcgcgcctgtaatcccagctactcaggagggtgaggcatgagaatcgcttgaacctgggaggcagaggttgcagtgagacgagatcacaccactgcactccagcctggacaaaacagtgagactctgtcaaaaaaaaaaaaaaaaaggaaggaaggaaggaaaaagaaaagaaaaaaaggaaacaaaagtaatagactaatcttaggaagctggctggagtagaatggcatagagcccccaacggtaccagcaatgtggggtaggtaggactcagctcctagatcttcttatggtcctcaggacataagaagcacactaaaaggcctatagaggatagatgatgcccatttaaacctttaattctgcctaaagttctgccaggtttatgtacgggcatagtgcacataaagcatgcataagaatgcatattttttgccttgcctttagtttttccaggttttcatgatattaacaccaacgattatgtcagagttatgctttgttttttctcaatgggagaaatccaagcataggccccctaaagaatgaaatgtaaaacaatgactcctgcctgatacaaccagaaggaagattgacaatacaacatgaaaagtcacggagtaaattattttcatacaagtggagaaattattttcagggaattcgtagaccgacagctattcacaggccatcaaacacccataaggacctttgtcatccttcaatcacttcagtagagagagaacatgtatgaaagagacagaaaacacagttaaataagcaattcctgttcagtaagtgtctgcagggagtttttcagagtgtgtacggataacacgtatacctactcgatcctacaagtgcgtggttctgaacagaagcaaatttgaagtattaataacaatgaagatggaaatagggttgttgaaaattctgtatttaatgagtgaactcagcgactgcagacacaaagagtgtggattctccgaatgattataaaagccttaatagaaataaatgattactaattggaatgggacatgaaagaagataaccttgttacaaagattccaggcaaagaaagaagagatggttccaattacaataatcaaagaggtgattttcttagaatatggctaaggaaacacattttcattcatttgtttcattcatttttttagtgcagtgtttgggaactaacctcagtactagtgaacatatgatgttaattctttagcgaggccaggagcggtggctcacgcctgtaatcccagcactttgggaggccaaggcgggtggatcacctgagatcaggagttccagactagcctggccaacatggtgaaatcccatctctactaaaaatacaaaaaaaaattatccgggtgtggtgacgggcagctgtaatcccagctacttgggaagctgaggcaagagaatcgcttgaacccgagaggtggaggttgcagtgagccgagatcacaccactgcactccagcctgggcgacagagccagactctgtctcaaaaataagtaagtaaataaataaataataaaaataaaaattctttagtgagatgaactgttaatggttgattccataatactgattctcattataaattactgtaacttttagttgtcttaaatattaaacaaaataacaacaatagtgccaacaagtgctgctagtgctgaaaatttcttcagattgttagaggaacagtatttcagtacatatattttgttacaatttcgagaaagaattcaaaacccagaatgggaataacaaagaccttttagagttgtgtttctcaaagaaagaccccaggaatacatgacttgtaaagacctaccagaagaatatcatttagaatggggctttagaatctgcatttttaataagcattctaggggattctgctgtattctagagtttgggaaggactgcctagtagattgtaaggccaaggtagtgattaattgatctaggctagagtaaagctgtggctgaaatatttttctaagttctcccagtgagtctaacagccaggagaaagaacacctgtgcattggcagtgacagcggaggaggtattgtactttgccaaggaagtatgcacagaatcatttttatataggtaataactgtatatctaacaaaactctatttcatttcactcttaaattcagaaaaaaaatacatgtaattcaaaataaacgttatcactggatatggtagcaaaacaacagtgcgtagatatgtgcttatgtttccgtgtgagttctatctatgtgtgtgcttatatatgtgtacacacacatatacacaacacatacagtgagagaaagagaggcagtttataatcttccaacatttttggcttatgtcaacctgtaggttaaaaatctgactttgtgatgccaaagaggaaaggtataggaaggagcagagaaaataactcaaatatggtttacttaggtatgggaggtgaaagattatttgtggcatcattacagctttgtgaaacaattggcaaggttgtgcaaagtaccatcttgatcagtgaagctttttcccttaaggatggattacaagtgtgtaattcaaccttgacttgtagacctccatttcctctctagttatgtgaatgtgcaccatacaatacaaagttctatacctattactttaaaccagtaacgttttattgtacttaataatagtcttaggctatctaggtaatctctgtttataggtgtttacaaagtaatattattttatgtaaactaataaaaacgttggtgctaattgctttacacattgcttggaaaagcaagccatttttgcagttgagtagttgctcagcactattggccaatctatttctatagcttcttgtttttcatctccttcaacaagttcatctgccaatattttgctccccgtgttgctctaatctcaatttctatcttaaaaaaatacaatggtaagggggtactttgcaagttaggcctaagaaggagactgatttcccaaggatgttcacgttgatttattgccttttaaaatactagttgcacaatgaaatgacaaattctgccaatttacatactattcctagtgtcattctttcaatttttcaaccagaattcatatacacagaaaacatgcttttcttgtttcctgagttccttcaagcaaaacataattctataatgagcaattatagcctaacacctgctgctatgaagaggaccttgtcaacatctatctaaattgaagaacaacagcattccttgattttgggaaaatgagcaataaacgaagtccatttcttagcagaaaaactcataggcaatgtattccaaggtagctcacagaataatcaggatttaatagaattagattttttaccatcatttgagagaaagttttgctctgggctaagtattatggttaaggaatccaagaaaaacactaaaattcctggatcccttacaggcaatatttacttaaaataaaaccatccataaaagtccttctctactatagtatctcttcctgtttttcttatgaaacaagaactctgctcaagctgaaaggtaaacaaatcggatagaagcatcatttgagctcaagccatatcaacaatcttgtggatttacattgccaggaaatcttttttcaaaattatgccgggataattacatcaacaaaaatggaggcagaaatcttggtataatatcaaaaagatgggggaagaataggttgctggaaaaagcctgctagcagattgcctagaaagaaaaatgaagccattctaatatgttaaaatctcatctaaacattgaaataaatgattattcacttacagagtaaacagatatgtttaagtgtatttttttacgtagtcacatgtatatatgatgtttctgtgtgcctatgtacacgcacacatacatacacacacttgaacgtcaacttgtacgtattaatagtgcaataaaaaatgttgtcagggatgacttcccctctggcattcccagcactatgactgacagctcttactgcatcaatagaagaattgtatttaaacaaaagttatggtacaattcctaggttgatgcttaatagacagtaaatactacaggaactaccaataagcttccttattaaataaatgtatttattcatttgatcttatgtaaagaacacaaaaggtaaaagaaaaaaattaaaaaagagtattttatttttgtataattaaaaaatctagttccttcttcctggatttgaggtatctatatctgtatctatccatctctctctctctctctctctctctctctctctctatatatatatatatatatatatatatatatatatatgttcatatctatatcaatattgataatgtttctttacttcttaaataaagaattacctaagcatcttttttcaagcgggagaatgaaaacacaattattctaagatggcgaatattgacaagggaatgaaatggtgaaagcaaatctatctagaaaaaagggcccccttagcctgaatgaatagaccagtgaatgaggaaacaaaatgattaaatcaagtcttttgaaagcacagcattattgtgagacatattgtaaagatctgtgcagctattctgcccttcctacatactcattgctctctattatacaaagaaggaacacagagaaaagaacattatacttgaagttagaatacctgggtttgagtgtgactttatcacttactaattatgtgatcttgaacaagttactcaacctctttgtgctcagtttccttttctaaaaaatggacatacaggccggacttggtggctcacacctgtaatcccagcactttgggaggccgaggtggcagatgacttgaggccaggagttcaaaacaagcctggccaacatggtgaaaccccgtttccactaaaaatacaaaaattagccaagtgtggtggcacatgcctgtagtcccagctatctgggaggcagtggttgcagtgagctgagatcacgccacttcactccagcctgggcaacagagtgagactctgtcctgattaaaaaaaaaaaaaaaaaaaaggatatacaaatatccagggctaattggagattcagatttgataatgcataggaaagatcctagtacactataagacaccttacatttataaagtagtataattgtcatccacataccattattattacatcatagtgaaaaaatacaacttacaagagttcagctgagcttaaagaatatattcatttgaagcccaatcattgttgtgtgagcttcttcatattatcttatttcaattattatgcttttatcttagactctaattatatatccagttttacttacgccattaaatgaattttaaaaggagtcacattaaataaaggccctttaaattttttatgagataaagagttgccatagacacactcttttgcatcttacccggtacagtcaaactcaattaactattcagactggcaaagcatcttttacatttttcgtaaagattctaagtgaaaagattgtactatttttcaattaagttatatatctttcaaaaatagctggtagattaaagcaaaggcactgtcacaatcacagattctatttagtgccatttagaggacaaaaatgaagccagctagacttgaaaatgtgttcatagtgatttttcaatgtatcaaaatctactaaatggaacattgaatggcaagtccaaaggcatgtgatggttaagaaatctggtcacaggcccagcgcggtggctcacgcctgtaatcccagcactttgggaggccaaggcaggcggatcacctgaggtcaggagtttaagactagcctggtcagcatagtgaaaccccttctctactaaaaatacaaaaattagccaggtgtggtcgcaggcacctgtaatcctagctactcgggaggctgaggtaggagaatcatttgaacctgggagatggaggttgcagtgagccacgatcgcaccactgcactccagcctgggcgataagagtgaaactctgtttcaaaaaccaaaaacaaacaacgacaaaaaaatctgggcacagataattacacaaggatttcacataacctctctgttattcatttagagatgtctaaaagtaattcctgagaaatttggaatttttattgaacatgtcagaatcttctctaaataacttctgaatcacctgtaaatgcaccattgatttggataatggtggaatctagctgtggaataagttaaaaggtcataaggcctccaagggtgaaatttcagtgaggtaaccagccaggctacggagcagctcggtgagcatttcatcagtttggagtagaatatggggagatgataccttttctcaactcaggtaaaaagaatttgaccaagttctcataccagcttttatgttacacagctgtttattaccatcaatgtttttgaaaactgggcagcataatttccatcatgctatgtccctggttctacttattatttggacctcctgatttactgactaaaactactatttaattatctgtatacaaattcaccggccattttcctttgaggtatccctatttggccagaaaatttagagcaaaagatgttcaattcagaaatttctttttaatgttatttatcagttttaactgatatacataatctttcactttactgtcagagatttataacaaaattatccagtgatatctactgaataaaaaagtaatgtttatcctcagtataccaattgttcagttttggtgcaaggtggtttaatatgtcacagctctaggtaagaatatagtaagaaaccctgagagggacatgtttaattgtaaaactgtgaagcacataaatacatacttactattatcaataataatagttaccatttaaatattgcctgctatatatcacaaagcactaagaggcttaaaatacatttttctctgtcctgtacaattctatttaaaaataggcaaaatttctccactttgtatgtaaggagaatgagtcacaaaaatgttaagcaacttgatcaggcccaactgccaataagtttgaagacaggattcaaacctcagtttgcctctccaaatctcaggaactataccaagccatgagttacatattaaacagctaaggcaggtgggcgtggtggctcatgcctgtaatcccagcactttgggaggctgaggtgggtgggtcacctgaggtcaggagttcgagaccagcctggccaatgtggtgaaaccccgtctctactaaaaacacaaaaaattagccgggcttggtggcgggtgcccgtaatcctagctactcgagaggctgaggcaggagaatcacttgaacctggcaggcggaggttgcagtgagccgagatcgcatcaccgcactccatcctggacaacgagagcaaaactctgtctcaaataaataaataaataaataaataaataaataaataaataaacagctaaggctaacagtcaatattaaaaattataaacactaaagtgtttctctaacttattattttgcatttaacaaaataccattttcccataaagtctattgttaaagcaaactaaatacggcctgagaaggactccgtacttctatatttgagtccctgtggatgaactacaacctatctcaataggtagacaagattgaaaaactaacttaggagtatgggcctgtgacaatcactcagtcttggccaatcccagccgccattcttcagccagttatacactgctgattgttcaaactgtgttcaaataaggcaaacagcgagctgtaaccaatccagctgtttctgcatctcacttccgatttctacatgtcactttacttttttttgtctataaatttattctgaccacaaggcacccctggagtctctctgaatctgctgtaattctgagggctgcctgattcgcaaatcgttcattgctcaattaaactcctttaactttaatttggctcaagtttttcttttaacactatattttttttttttgtcttttagcatcatttttaaaaatagcatttaactcctttgattcagtggttgctatggtttcactatttatcccctccaaaatttaacccccagtgtggcagtattgagaggggaggcctttaagaggcacttggatcatgaaagttctgccctaatggattaatgagttaatggattaatgcattatcatgggaatggcactggtggcttgataagaagagagacctgagctagcaagttagcatacacagccctcctgccatgtgatgccccaggccattgggaccctgtagagagttcccaccagcaagaaggccctcaccagatgtgtccttttgacctgggacttcttgaaatggtctttgcaaaaattataacggtgagaaaatgatggaagtgaaagggatctaatctagccaactcctctcttgcctttagccttcaagctgctcttaattattcctgggcttatgccaagctaactttgggagacatttatagtttaaatgacaatagcccttccccaaaactcaaccgcgtttgtagagctaatgagagaccaccaggctaggaggataggggaaactaaattctgctgcggtgtagacatacaggattgccagccattattccagaggtcacaagacacgcgacttccccaactactcttgcagacaacatcactattgtagaacttaagattggccttttgagatatctgttcagatatatttcatgtctgatgactgatggctccacctgcacctgccaactgctcctgtggccccgcccagaagagactcagtgcacaggaggacccttgcccacagtcctatgattgcaatccctaccagtcagcagcaagcacctattgcgtagctttccacatgcctttccccaaaccgatcttgaaaaccctagcctcagacttcttgaggagactgatttgagtaatagtaaaactctgatcttctgcttagctggtggctgtacatgtataaaactctccattgcaattcccttgtcttgataaatcagctctacctgggcagcaggaaagaagaacctattgtgcagatacattctgagcctccataactgtaagaaataagttcctttttgaaataagtaacctagtttcaggtattctgttttatagcaacagcaaatgaattaataccgagcaaatgaattaataccgtattgggatatcttagatgttttggcattgaagctttgtcttacgaaaatgcattcaggtattgaaaccaccattgcaaaattataactgaaatagtgaaagagatctgatgtaaccaactccctcttgcatctaagccccaggctgtccttgctcattcctgggggtaagctgaaataactttgggaggaacttagtttatagcttatggtttaaaacaaaggcaatgacaacccttccccaaaaccaacctccttcttgcctggggactagactgcctttgtaggactaacaaaatagccaaaagattagaaattacggtttagtagtcatgcagctagagactacaagatactgcttctccccaaattgctcctgggcataaagtcaccattgtaaagcctaagatcagtgcttgagacgttttgcagaccctgcactcgatggatcaactggtaccacacagatcaataaactggctcatctcatcctatgaccccccactcaggaactgactcagggcaagacagctttgactccctatgatttcatctctgatccaaccaatcattacttctgaccactggctgctccccacccaccaaattgtccttaaaaaccctggtccccaaatgctcagggagactgatttgagtaataataaaactccagtctcccatacagcctgctctgcatgaattactctttctctattgcaatttccctgtcttgataaatcaactctgtctagagagtgggcaaggtgaacctgatggcaattgcagtatgtatgtatacccaacatcttgtatgtaattttaagggatgcaaggatcccaaaataaactagaactttagggtgatcgagtgtctggtgtgcctgggggctaagcaggtttgtgggatatgggactttaaattttaaaactgagaaattcctgaaaaacaaaaacaaacaaaaataaaacaagaaaagttggttaccctaaaatgtaacgtttatatagcactttaataaatactatttactagaagctaaggcttttggttatgtatattataaattaggccatagggcaaagcaagaaaatgaaagctttactaggtcaaaactgtgaccgcccaagaggttcaactcgcctgctgcctggacagagccgattcatcaagacaggggaattgcaatagagaaagagtaactccctcagagccagctgtgcgggagaccgaagttttattattactcaaatcagtctccccaagcattcggggagcagagtttttaaggataacttggtgggtggggggaagccagtgagccaggagtgctgactggtcagagatgaaatcacagggagtcggagctgtcttcttgcgctgagtcagttcctgggtggaggccacaagatcagatgagccagtttattgatctgggtggtgccagctgatccatcaagtgcagggtctgcaaaatatctcaagcactgatcttaggagcagtttggtgggggtcagaatcttgttgcctccagctgcatgactcctaaaccataatttctaacactgtggctgatgttagtcctacaaacgcaagtcccaggcaagaaggaattttgctctgggaaagggctgttaccatctttaaactgtaaactaagtttctcccaaagttagttcagcctatgcccaggaatgaacgaagacagcttggaggttagaagcaagatggagtcagttaagttagattgttttcactgtctcagacctaattttgcaaaggtggtttcaatcccttcctttgggttttctaacactttaaccctaaggtataggctataaagatgggaaaaggccgtcgatcgctctggcttcttcctgctgatgggggaagtagcgggaatgggaacgaactccaaggtgagaagagtggaactgctttgcaactgtttgagtggattcatgcaggcctaattgggcttccaaggcttgcgtggcagaaacattattactctcatctatagttttactacagtgtttatgtgaatagcctactataaggtataatgagtcctaggatgagaagtacaattcccaattttaaaagcaaacatttgaaatcattagtttgggaacttctaacccacaaacaatttagaatttagtctaaactgaagaattaacctcaagaatagctaatagtttactatagattttcttttgaagcataatatttctctgttcagtccccatttttattaaaaacaaatcatgatagaaatgatttgcttataaaatgcattttagtcttactgtacttggcctgattatttgcatgaagtgcagcaagaataattatttttcacttaggctttttaaattggctttgatggaactctgttccatgaagaatctcagataagactttttgaaagccgagcccagccatgggtttgtaccctcaaatacctatgagttgaccaaagtcctctcctcttgaggtcccaagataacttggggttcctgggcctgttagaaagtgacattctttacttaccacaggtcaggaaccttgtacagggactctgtgtggacaaggtatgaggccagattccccaacgggctttaaatggctctataagtcaactttgattctttaaaggaagcatgccattccagtcaaagccttggtaaaatgaccaatttctccaatggtgtcctgttacaaaagaaaacagattcttattgcacgtatgcaattaactatactgtcataaattgagaatactcacaaatggtttccaaattctagagaaatcaggtagagagaaacaaatttgctccaaaatttgtcactgagtgtattttactcactcggtaaaagtggcaaatagctctaaagaaataagttatgttgactctgaaaacaaaaggattagcaatgtttaacacatcagtttgccacatttagatgttttttccctctattccaagagcataatttttaaagttatctaagacctgcactcagagtattatatccgattataaactgccttttgaaaaggaccaaagcaagataaaatgtctgtggatgacaaaagtctacagccattattaaagctacaattgactaggaattttggttacttccgtggcacacaacaattttacataacaattataattattaatagtgaaatcatatcagaattatagaagtttcccataatttttggaacacacactaataacatatttatacaaatacagtccaaagaaaaccaaacaccattcactcttctatttgaaagttttccttctattctaacgtcacaatctccagagttattaatcagaaacctgcatttaagaccacctgttacattttacagctggtattaaaaccatttttttttgagacagagtttctctcttgttgcccaggctggagtgcaatggcatgatcttggctcaccgcaacctccgcctcctaggttcaagcgattctcctgcctcggtctcccgagtagctgggattacaggaatgattttgtatttttagtagagatggggtttctccatgttggtcaggctggtcttgaactcccgacctcaggtgatctgcccacctcggcctcctaacgtgctgggattacaggcatgagccaccatgcccggcctataaaaccatcttttaagaggacaaaaatgagacaacaattgcctgtggacgacacaaacattgtagagtagccagagttaaagacacaatcgacaaggaaatttgttacctctgtggcacatagccatttaacataattacaattattactgataacatatactaagtcatattagaattataggagttttacataatctcagaacatatgtcaatcatatatttacacaaatatagcccccaaaaagccaaacaccatttcatatttgacaatgtttcctgtatgatttttatgcaaaatacgccaaatgtcatttttggactttagaggacctaatatctaaaagattaggccagaaagagacataatttataatttgattttggaaagtttgccaaatatcaaaggtttaaaacactggatatcacaaaatagaatcccaggtcaccataagtcattcatttgaccaaaacgataactccaaaatcttaaaagaaaaacctttattctgacagaggagacttagctttccaaacaagacccaataaagacagcatgaggataactgaatttgtctcttctctctccccttttcccctgccatttacccaaaggagaaagccaaaccctttcattatcttttaacgttacaaaaaaatcgtcttcaaaagagaaaaccaaatttcatgttcgcattagtgcatctttaatgctaaagctagtttttaaataaaattttatgtatctatccagttttaattagtttgaccacaaggtgacattctcataaactttttagaacgctttataattttccattaaacagcagatcaattttctaagaagaccctgttatttggacacatgggcccagattctggccccacagtatgactttaatattttaacctatagaaaaagctaaataacctttttcaaatcttagccaacttgtttatacccacagaattttttttttcaggatcaaccctgtataaacccttttcactttgcttaaaccctcagtttcgttccgttactcttttagtttaagacagtctttaaaacctctgaactagacaaaattacattctcttcaacaaaagccatattcctatgccttattatctttcaccaaaaacacattccctacacaccttgtatgtaaaactgtttctccagtaacctcgatttcatgttacaatgttaactcttagcaactttgatttttagtgaaaaacctgataaaaaagctattttaattatatgctagggatggagcctaggacatcagacagaagtgaagataaggtctgactcttttcagcatagctaggggcatagctctccacgtgtccccaggcctcatctataatataatgctccaaagtaaataaattgaacaattttccaaagtcaaggaaacagtttgaccttaaagaatttagcaaatctgatagctgaccttaatttagaccaaatgtctacattttcaagatattttactttaacaataatctttaaaattgtctttattgccaaaagattactaaagtcatgtgaacaaaaagtcatcaaagtttctatttttctgacaaaatatttttttatttaagcacttattttccaagccaattaatcagagctcttttataaacatcacacacacacacacacacacacacacacacacaaaaacacatgtaaatacagacagaagatttggcactgataagactttttatttgccagtttcttaatcagattactggcttcagggtggagcctttggaggaacagggccaggaaagtatgcatttctaaggcttaatcacagctgaaggcaaagacagaactcccaaattaagggcaccattttatactgcaacccaaaaggagagaaatactacgggagaagacagtacagtgcttctaccctacatttcttttcttatttttgtttctttctttctttttaagacggagtctcgctctgtcacccaggctggagtgcagtggtgctatctcagctcactgcaacctccgcctcctgggttcaagggattctcctgccttagcctctcaagtagctgggattacaggcatgtgccaccacgcctggctaatttttgtatttttcttagagacggggtttcaccatgttggccaggctggtctcaaactgctgacctcaagtgatccgccctcctcggcctcccaaagtgcagcctcccaaagtgcttggattacaagcacgagccacggcacccggccataccctgcatttcattgcaaggcaacccaaagtcaatcagcccattttgtaatcagcccgtccttcatgggagtctgatctcccagtggagggtgaggaatgtttccttatcttccgggtgaccaaaagcatgcttctctggatccaagtgtgcaaagagtcaagtatccctgtataactaccattagccatcccttaaagtatatttcctatctagttattacacactaaagctccctcataatgtgaagtaatttctgatatccccaaaactcaaaaccatcagataacacaatgaaaaacagagcagagtctttgattttgagagggatccatctgtttttaattcctggggtttcatgtggaaaacagttttttttttttttccctaaaacgggttctgtggtgcctcctctgtttttcccaatgagtcccaggctaccagaagttatcttagggactcacgtgtgcgttaagagtggcaagacaaaaaaattaaaaaagagaaaaaaatggagaaaaataattcagtcggctgagaagaaaaaactttttccaaaaaaacaagttccaagaagagaaaaacataaaggccttttaaatatatctatagcttgtttatccactcttaattaagctgacttttaaccatagtgctctttaaaaaagaaattcttttagatctcttattacctaattttagccatgccaagtggacaatatttttagcttctgaactttaccaaaggaaacctcctaggtgctgcaaagacatagtaagaagtttctttttacaagatttagaatctccacaaggtagtccagagaaaggaaaattcaagagaggaaatcagaaaagaaacttaataaatggcaaagctacacaaataacaaatcagaaaggaatcattccagaagccaacaattgaacccaggccaccactgtcaaaagacaaagccttagctactgagctatatacagcgttgagaaatttctactgcttttcccagaaggagcctagagaagccagtttcaggcttgcaaggcttttaactgctcaagaaaaatcttaggagtaactatgacatgaaccccaaaattcctgtcctctggatggtagaaaccaaaagaaagtatccccacatggtcacaaggttaagctcttaaggacacaaaacaagacagagaaatttcatagagtattggtttcagggacctgtagcaaagtttgtagctgaccagcctcccaagctgacttgaaaagcagacttatgggtgtcctaacccacgttctatcacgtgatatccctctctccattacataacacagaaagacaaattcttagcacaaactacatcagatgtgctaagattagtctcacaaatccttctttctattaaccaaacccttgcagaggagacaaatagtttactatttaacaatgcagagaaagagagagagagagagagagaccagaaacttgactgataagaatttcttacccttattgctgggatgccaggtttctgggttccctttctctgcagcttccagaagaacggagtggcgtcttacgaccctgcttgcttgtgctatagctgtggggtttaagccactttacaagataaaatcaccctttaccattttatggaaccataaacaagattcttaatttgcaagattctgcccaacgggctgcatggggaactgaattaacattttccaacccagcaaaatacacataacaaaacagacattagtcacctctttccgcacccaatatcagcctggcaaagctcaaaatttttcatcttggtccctgttgtctttgatccacaccaggtggggacggatgacctctgaacggtaattcacaatgaggtctctgggcaagggaaagagcagatagtcaccctgagagacaggactgttgagccttctttagagctcactgaatgtgaccagacaaataaggagggttctctgagttaggcatgctggacttctatcagcaaccccttctgagatccctttcacatatttaaacacatgcaaagacaagagggacagaaggccttccaaatcagatccctaaccaagaagtccaagagtatcccttccaaactatcctcctattttctgtatgagaaacctcctcaaaatcttcctgattgaagagaagtctcccaaaccagtagtcttcctactagttagaaagagcgaactgagacctcccaggagctgaacagacaccccacaatggagtaacagacagagacaccccatgctggatctacagacaccccacaatggggctacagacaccccaccatagggctacagaaccagtcaggagaatgaagcaggcattggcagcacctaggatactcaccaatccagacaccccaaaacggagctacagatagacaccccaccatgaggctacagataccctgtaatagggctacagttaagggacatctccccatgactatttttccattgcaattaagtccacgcacattgggttggaataccccaccagtagacagagtaacagagtcagcccccagtccaagagaattaggcagccacttgggctgccttctggatccatcactgaaagggggccaccaaacaacaggcaggtagccacaggggcaatcctgggtgagcccccaaatttgtaaccacccaaggggttcaccttgcccactgcctagacagagctgactcagcaagacaggggaattgcaatgaagaaagagtaattcatgcagagctggctgtgtgggacactggagttttgttattactcaaatcagcaaatcggtctccccaggcattcggggaacagagtttttaaggataacttggtgggtcgggggaagccagtgagccaggagtgctgactggtcagagatgaaatcacagggagttggagctgtcttcttgcgctgagtcagttcctgggtggaggccacaagatcagatgagccagtttattgatatgggtagtgccagctgatccatcaagtgcagggtctgcaaattatctcaagcactgatcttaggagcagtttggtgggggtcagaatcttgttgcctccagctgcatgactcctaaaccataatttctaatactgtggctgatgttagtcctacagaggcaatctagtccccaggcaagaaggtctgctttgggaaagggctgttatgatgtttgtttaaacgataaactataaattagtggaggttagaagcaagatggagtcagttaagttagatctctttcactgtctcagtcctaattttgcagtggtggtttcaaaacccttatactttattttaccataaacaaatgagcttttagtaatgaattctaatgactgcaatggggtgggggtggtgagttaattgttatcagttgtacaaggttgttttattgtagctcaaatgttggaggaaagggaagctttatggtattatgtttcattaaactaagataggctttcagaattgtacaaaacatttttaaacctatatgtattactgatgatttaagtgagtgtatcagggaaataacttgtttggtgaaaaatggaatatggcctgaaaacataacaacaacttcgtaagttgtccattttctcataaaaataatattgacttacttatatattaaattagtgattcaatttctaaaggccttacaaagatataattcagtattttatggtaattattttctaattagaaatttacttttactatagcactaagtgccaccagtattaattattgttatttccttacaccatacttgttcctagtaaaacaagcttcagccactgttctctataaaatatggtgtcttctagatgggaacaagaatattttacaacacataacctcccatttctagggttgtgacaaaatgcattttatttcaaatggcacgcaatattaaaacaactcagtttatgtttcattaatcaagaattcaaaacaacctcattttgtaaatccataatatgcaaacttggctacagactgtccaatcagattttattctcctttcaagtcagattttccttatcctctttacttacactatcttaccaataggctgtcagatgctagtatgttctgagacattcagtatctcttatcactcaccactcatatactctcagggataaaattctgtagaggcactcaattcgcatagaaacaaccataaaacccagttttgcaaatattaagttagaaaacaattggcatagcattacactatggtaatacttactatgcactcctaaaatttagtgttgatcttatgccatgatgtaaaaacaaaaaaagaaaaaaagttattagtacaaagagaaaaatgtcagatgtgtataatataacctctgatttgactaaaatatgtgataacattcacaagccagaattgagtagagctggcagttcacagaaggcctgaagcctagatgtaatcaatgacatagctgaacttgataaatcaacacatttacataaggaaaatatccctgattatcataggattgaaccttctaaattatctgttgacagtcaatattctgatcattttcttcactgtgaattcagacagactatcattcaaaggtttgctatacagaaagagaaaaataccaaaatgctaaggcacaaatatcaaatctctttcccatgaaaatcagataatttagaattttttaaagttaaccttgaaatgtgactatgtaattaaaaaaaataaaatacttttttgtgataagtcaaaaactaattataaggtagaacatttgctaatatagatttcaaagcaacacctgttaataacatatgttcccattttaaaagtaggtaacagaaattaataactcatagttatataatggggttccaagattttatagtatgaaatgtggtaaaaggtttggtatttattataggatgtgaaaggccccctaaagcacttttaattactcattcatgaattgctaattaatacttccaaactaaaatattaaacactttagaaagactgacccaatattaaaatccaagctgttagattttaaagtgtatgttaaaaaatatttaaactataatatctcttagtgtatatatacacacaaatatctgttttcatatatatgtttatatatattttatatatgtatataatatatatacatagagagcgatagagggagataaaggaagggggttttgtttgtccaatatattttagctgaccacatcattttatgtatttttttatttaaagggccaaggaataaaataagaatgcgaaggtagaatgcagcactttatcctcaattagaaaaatgcagaggaatttaaataattagacttttccacaaatgttatgtttgttgccaggaaacacaggtgcttctaaactcactgctttaggccatgcaaaatttaggagacaggccaattcccctcctctagggaggaaacttgtcagtcaggaaagctcaagagattagcatccaaagccagtttacttctggggctggttaaaagctttcagaggattcctgtgtaattgctaaatattgtaggctaaattaaagttgttatttaaaatgtaaacatcaatagcaactaacatttgattcttgctcttggtataaaaaagcaataaaattattaacaccttggaaagatttgaaaattcattggtagcattaagcaagtaaatatctagcatttagttcatatggcgagaccaattgtgagaacttaaaatacatatttgtgttgatgattctggctactgtttgagaggttatattgccctcttccccaaggatttctcaagaaatgtttatttgatttgtatgatacatttccagctttgttctcagaaatgtcttttctactcacattcattcattctgttcagtacaatactgtgttcattatgctgaggctttaaaattagaaactgtgggggtttgaatcttgtttttgccatgtgatagctgtgtgaccttaggcatatttcacagcctcccagtaaaataaagataaaacagatctttcttcatagaaattatttcaagcattcaatgaggatattaaaatacagaacttagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatatatattatatataactcgatattatatatatacatttctttaggagatactcatggctgctctgtgtccaactacatttgggagtcacctcttactgaatccttttatatactgggtcacttgcaaaggcttaattgagcatttgactatcatatgccacagaatggatcggacactataaataaaacacaaaagagagtttgtcttttctgggcttcatcttcttaaaaaaatcagctattagacaagcatatgtctaattatatatatcaagcatatgtcatattatatatatcaagttatatatgttaaacatcatacatatactgtaggtagctttttgtggtcacaaagctttactattattatttttatgtacttcttgagaaaaggctatctataacaggataattttaagtaaaaaaagcttaaatctttcagtcaatgttcatatattatcctcataagaacaatttgtgttaggtattcttttctattttaaagtagataaaatataggtacaaacatgttaagtaatttgtctgaggtactagaggtatggcgagaagctgatctcaagccaaaatgtaaaggcctatgtttttctgattctcctattattttggttctatgagagaatgttaaagaaaacataactttttcccaactctcagtccaggactgagaaatctcaaacactaagcatatgagtttgtgagcgaaggtttgcacataaatgtatatactcacatttatgggaatatatgatctgtacttaagccataaactaaatttaaaatttatagtttaaacatgatatttcaaaattctagtaaagcagacacacacttctatttacttttctatttatatttatgtatcttctggtccttttactattttatcaagatacttgaaagcagggatacttaaccaaaagctggtttaggaatggattatgaatggcttatgaatggattgcaggagcatttgaactgctggatttttatgtaaaaggttgtatgtaaaggatattcactgtgtatttttctgaggagtcccacagcttttatcagactgacaaaggatgcatgaactaaacaaattaaaaagcaattaaggtctttataacctctatacatagaaagttctatgttttttctactttttatttccagctggacaaataatgtcttgtaaaagtttagttcactgttttctcccttcaagcccccagtgaagtaggagatgatgttatctatttagtacgggctggagataataaattgtgaacaaagtgaagaatagtcatgaaggctgctttacagaattggaggtaatttggtgtcttttatttactgcagctaaaaggttcttcaaaataagcataatctttgcttcagctacatgtgtttcttccagattttctaatgctcttccacatcactgttttcttggttcaccctttacattttagataaatattccacagtgagaccttcctgatcccaaacctgaattaaataaatactcttacgctctctcatgcacttatttttatttagaaaatttatcataattcttgactacttacatatgcttgtctaatagctgatttttttaagaagatgaagcccagaaaagacaaactctcttttgtgttttatttatagtgtccgatccattctgtggcatatgacagtcaaatgctcaattaagcctttgcaagtgacccagtatataaaaggattcagtatgaggtgactcccaaatgtagttggacacagagcagccatgaatatctcctaaagaaatgttccacaggctgaaattaaggcataatctctagaaaaatgttttttaaaagttgtgctttataatatcacatttatcatggaaatatatctgatcattatgtatcaataacagaaatgtgtgctttactattttctttaggttttgctaaaacttactaccaaatatcctgaaattaatttcactttaaagctaaataaattggtctatatacactaaagtcataagtgaacattttcttttagtagacaattatacaaaaaaattcccttttcctgaaggcatttcttgtctctgaaaataagaattttataattggtcttattttccgttttctttggcttctaggggtcccagaataacatacgaatcaattatttatcttcttagccaacacccttaatccaagcaactgacctcttttgctttgattacattactttcaatacattctcataacctcaccaataaagagctatttgacagatgaatgtgatcaagacaccctttgcttacaattcttcaatagcatactactgcttttaagatagatatccgaactcaggagctttcatttcttgaatgaagaggcttctgtgtagttcctcctcgtcttgtagcaccgtaattttcttttttatttatttattttattttatttatttatttttgagatggagtcttgctctgtcgcccaggctggagtgcagtgtcacgatctcagctcactgcaacctccacctcctgggttcaagcgattctccagcctcagcctcccaagtagctaggattataggtgcccgccaccacgtccggctaattttttgtatttaaagcagagatgaagtttcactatgttggataggctggtctcgaactcctgacctcaggtgatccacccgcctcggcctcccaaagtgttgggattacaggcgtgagccactgtgcccagcctgtaattttcttcttagatatagttaccctggcctttctgttccttcccacaataggagctttgcataagctctttactccaacagaataggcttccttgatattctctttctgaatacagataatgtaaatattactttacgttgtaaatattaacatttctctgactgagtgtacgtcttccccattgacagtaagtttcacaaggataggaaacatgttttcagtttttgtcttgttactgttttgttttctcatcatactccagcaactagcaccttttatgtactgtttttaattaaaatttgaatgagtgaactaaaacatcaggccttaaatctgcatacatatttggctctagtcaattatatatatacttctttattttcactaatttggttgcacattttattatgtctccaaatcattgtgaaagacagtaagcaaaaactgacaaattagtacaatcttggaattcatgtattataaaaggctggttcagattgttttactcaattgtaacatgttttgattgaaacggtgtaaaacaggaaaaaattatctagaaccaaacttttattgcatgttggctatggaaaagtacaaataataactaagacgtaatcaactaggccataatcttgatgagttttcagatttgattatattatatatagatataaaataaaggaattaatattttaataaaatcaatgaaacttcaatatattttacaatagattttaaatactatgttgattttttatgaaagttcagaacatcaaaaagactaatgcaacataaatttgccatgagtttatacgcaccttaaaagaaatgttcgcagattctacttgtatcatgatgggttgcttttgtgacataactattgaaaatgtgtgttttttttttctgcagtacaatcttcacattcagatttaattgtaatcttagccaacttttgctcatagaaggattaatcatatgactttttgtttacacacaatcacctgtagaaagcagttatcattctattcatttcttcattcattcaacaacactgacttttatgctactctatgccaggccctgagtgagttctgggagatactaatatacacttaagttctgccatcaatgaacttacagtcttttgagaaagacaaggcaatagtttcagcatgacttgacaaatcttaagaaaaaagagccagagaaacatagaaagagggatctaaattaggctagaagaaatagcaaggagtagatacagggaggaagggtgtcccagacacagaaatatgcatgtgctatataaaattacataatatatttaagaaagagcaagaaggccgggcgcggtggctcacgcctgtaatcccagcactttgggagtccatggcaggtggatcacctgaggtcaggagttcaagaccagcctggccaacatgatgaaaccccatctctcctaaaaatacaaaaaattagctgggcatcgtggcagtcaccagtaatcccagctactcgggaggctgaggagggagaatcgcttgaacctgggaggtggaagttgcagtgagctgagattgtgccattgcactccaggcagggcgacagagcaagactccatctcaaaaaaaaaaaaaaagaaaaaaaagaaagagcaagaaatttcatgtagttgggatcaagggcattttgaggtaagtaagacagattttaggttaaaggggtagccaagatttttaaattctaaacatatttgaaaggaaaaaatcataatctaattttttattactctttattacaaaaacaaatttggttttaaagatcaataaactacatttttaatacaaagtagtatatacaatatgcatgtaattaccttttgctatttcaagctttgctctgtgtgcatacaaatatatcaatacacatatataatttttaaaatacataaaatcttaatgtgtacaacacacatatgacaacgttttgaatatttaaacaaaagcaaatgacttgctaaattgcaaatatgtacatatggaaaatagatatatttgctcatgcaactgctttttaaaattccattacttctgccaaatcaagcaacactcacacgggtggtataagtacacagaaatagcgaacaacataaatgttagcattcatagatcagccttttatgggaatgtaatttttcatgtacaattcactcaacatattaaaacaatctttttatgtcccttgttatggttttatcagacaagcagaacaatttcaagggaacctaagagtagactatcaatattagtcattgctcatgttgtgtttacaggaagttcactaatttacattcgatttatattaataatcaagagtggaactgcaatgaagtgcaaactttctttttaattctcttttctgtagtgtacaaactcatgtatcagtagctttgggggctattagcactacctccagaatataaacctgtcatattttaaatttgcctcatttcagaagttttgtcttcttatattcaaaggagcatgcttggtatgagtcacagtatcaacttctgcattgaatgttttctaagccatctcaaaatgcatacaaattgttagaaatcaatctcaatttatttatctaacatatttacatgatatccaaaaatgaagacaggatagataatagaaatctaatataaacctgtaagctattttaacaacatcaaatgtatggtgtcccttaagagtgctaaatcaaacactacttcttccagaattttttttttttttttttttttttttttgagatggagtctcgctctgtcacccaggctggagtgcagtggtgcgatctcggctcactgcaacctccgcctcttgggctcacgccattctcctgcctcagcctccagagtagctgggtctacaggcgcctgccaccacgcccggctaactttttgtatttttagtagagacggggtttcaccatgttagccaggatggtctcgatctcctgacctcgtgatccacccaccttggcctcccaaagtgctgggattactggcgtgagccaccgcgcccggccttcttccagaatttttgggagatgtaaaataaagagatgatttaaaaagctctttgtgaatgcatattttaatctttactctggctctggagattttatagaggtaggtaaactaaagttgtgtttctaaataatgtttctgtaagatatatttttaaatctataagttaaaatgtttcagagagataatgcgatctgtttgaagccatgctatattttggagacgactttttttttttttatttttttgagacagagttttgctcttgtcacccaggctggagtgcaatggcaccatcttggctcactgcaacctctgcctcccagattcaaagattctcctgcctcagcctcccaagtagctgggattacaagcatgcaccaccacacctggctaatcgtttgtatttttagtagagatggggtttcaccatgtgggccaggctggtctcgaactcctggcctcaagcgatttactcgcctcagcctcccaaagtgctgggattataggcgcgagccaccgcacctggccaaagggacaatatttctttaggtcaaagggaaagtttacaacaaaccacgtaaccacacaaactgcaagaacaaatatttcccttctgagctgccttagcaaagggtatctgggaatatcaaacagaatgattcataagcaaattataatgtccagaatattcaaattttcaatatcaagtttgtgttttaccagcagaatcaaaattataagaaattatcgagtttggtctcagtatagttctatgtgctataaggatcctccagaatgtaaaaaataatacctgttctcaagaatcttatttaacagttgagagaatgagctggatctgaataaaacacataaactatgattcttagacttttatcacctcagagatatgctaggaaaatactgtattttttaagaatccctttaaaaactttccttaaagcaataacacaagcattctagatggttccacatagaagcagaaaaaaaatacaagaaagaaagctctatataaccaatccctgatttaaaattgtgaaacaatctcaaataggtccagtcccatttcattaccaaacatctacaagtttatgctctgggtttaccatcttttgatatctcctccctaataccagtgaaagggatatggaaatttgttgatacagatgttactgtagaattaatactgacagtgatcagtgaaatttacattggggtggtaattagttattaatgatttaaaatttttacagtgtcacctttactgtcttctaacgatgtgtgtccaaaacagtatttatacatgagactcttttttttttttttttttttttgagacagagtctcactcactctgtcgcccagcctggagggcagtggtgtgatctgggctcactgcaacctctgcctcccaggctcaagcaattctcctgcctcagcctcccaagcagctgagattacaggcactggccaccacgcccggctaatttttgtatttttagtagagacggggtttcatcatgctggccaggctggtctcaaactcctgacctcaggtaattcatcccctcagcctcccaaagtgctgggattacaggtgtgagccaccatgcccagccccaccagtaacattttaagggctcaatagtcacatatggctattggctactatattggtcatgatagatacagaacatttctattgcagaaagttctattagcactatctgagcaatataactttttattgtcactaagaggaacttacctagttatttactctggtctgctagtatgattttacctgtaaatataatacagcatatttggactgcaacacataattgaatctttcccagataggacagaatatatgtatttgttctgttcagaaagattcatcccagtttagcggaagagaaaacgaagcctcaacacctataatagctttttaaatatcacaaaactggtgcttatctatcaaagaatactgacaatgccattaaaattgttgttctctgcgctgtatataaatatactgaataatattggttaatatgggtatgcctaggagcaagttgctaactttctttgaattatagtttctcatggtgtaaaccaattctgcttgaatgggtctgctgtcattggatgtggtataaaaattgtgaggagcttagcataaccataacctagggcaaacccaagcccttctcttaagtagcacggcactaaagacttataacttgagtgcttttcaaaggtgtgtggaggctgtatcctctttactgctccttccctgtgttatatgtaaacaatgtttatttagaaacagaatgcttgttccctggtgctgcaaagaaacagcactcgaacataaatttaactctctcagcaaggtcatttttactttttgcagaaagggtacactcgccagcagttttgccacgagagtacaccgaacaaaggagacagggtcatttataacctgacatgtttactctactgctgtgtccggtttccattggctggaacaggaccacacattctgtatttgtcccgattggctagcaacttagaacttttcaaaagagacaaaggcagaggagaacaaaggaaggaggaagtaacttgtttccacaagttacttgctgagaaaggtaaaaacaccttcaaataaggaagaggaacaggctatgacctaatgcgtgcttggaccagtataagcatgccagggcaaatatttaggctaaattgtgggaactaagaacataaagtacattgatttctttattacggctagtagatatttaagaatgttagcacaggtcgtttaataaattttgcttctaggagacgttactatttattcccatttagatgggtaggaaagtttctttggagagaaacctctactttttacacctgcaagagctcaggttgtaagtggctgtatttctttttcaaaggtcacagctcttgttgggcggtctctcctcagctcctccatttccaggatctagtaattgctccctcacattttaccttttttaggcctagtggtgggttatgtctttctattgtccccagagccaggggccacctgcatcacagtattcattagtttcccttaaccctacccacaactttgaatattgtttcttattgcctctcatagtttacccattttagcatgccgtgtgtttgttttcttgctgatctctgatagataagcatccagagatgatgatatgtctgctattaattaaggatttgttcgtcactccatatgagttaataaaagtccaaaatatgacttaaaattaacaaattttgtatgaacttgtggttgttccatatctatctagaaacatatctctagaatagttctcatttcatgtcgagattaagatatttagtatatagtggcattaactcttcatcttgcccattaaaggcaaaacagattgttttttaattatttcttcaaatggaacttcctttcataaagacaacgtgtactgtaagcattctttactgttttttacagccaagaaaaatcgacatagtttacacacctattgatttgtcataagatgtcaactagagaacaaaaaaaacccaaacagattaatggacaagagtgttaattgcaatgatatataaaaaagccaaaattacataatagctctaacgtaatagctctgacacgcaacataagaagataaagaatgaactatctataggtaatatttaaaaatatatgtagaaaccattaaggcattgttgactcaaggacactggaagagatgctggcccaatccaaacagatgctggtttaaaatgactggactattcttacaaggggcacaccaactcagtatcagttctacagcaaaaccatatgacagaatattatggagcaatgtaagtaatgattaagttttacaatgcaaagttagacaccaaaaaatatctaactttattaaggaaaaaataaactgtttagagaaaggatgttttagctgtgggtggctttccctctgttttaaaattatacttttaaaatttctttaaatatcatgtatttctttgttaaagatggaaacgatgaagccgggcacggtggctcacgcttgtaatcccagcactttgggaggcagaggcaggtggatcacctgaggccaggagttcgagaccagcctgaccaaaatggcgaaaccccatctgtactactaatataaaattagtcagggatggtggcgcatgcctgtcatcccagatactcgggaagctgaggcaggagaatcgcttgaacccaggaggcggagattgcagtgagccaagattgcacagttgccctctagcctgggtgacaagagcaaaactccgtctcaaaaaacaaaaaacaaaaaatgaaaaccatgagtaataaatgaaaatcaattaactcagagtgtattaatggaattatatgtgtatcaagtacaatatttaactaaattataattgtaaaactcctgaatttggatagaatatctcagaaatctacccctaccaattttttcatgttaatatcacctcttctaaaatctcatcagctcctaggaaatgcctagattttaaaaagcaactataacctatggataggatggtccctgtgtggccactaggaagctgctggaagagaaagagagatatagtatattctgtagccatgtgacaagtgtgggaccagaagagcagttagtgaggataattttgcacagcatttgaaattcttacattaaagatactttgttggcaatcgcagcgtttatttgtttatttggttttacatataaataaaaatgcattcctaagcatattaaagaggcacttgtattgttaatgtcctactaaagctaggaaaatacagtttttggatcagatctaaatttaagtctagattctgccacctaggagctgtaaaatcttgtgtaaattactgaaaaatctctctgaaccctattatctatattgatgaatgggcataagagaaactacttcaggccaggtgcggtggctcacgcccataatctcagcactttgggaggccgaggcacgcggatcacctgaggtcaggagttcgagaccagcctggccaacgtatagtgaaaccccgtctctactaaaaaatacagaaattagctgggcgtggtggcacatgcctgtagtcccagctacttgggaagctaaggcaggagaatcgcttgaaccagggaggcggaggttgcagcgggcagagatcgtgccactgcactccagcctgggcaacagagcaagactccatctctcaaaaaaagaaaagaaaagaagaaaaaaaaagaaagaaaaactacttcaaatggcttttgggaagaactaatgtgatagtgtgtgttgaatgcgtagtgcctgatagtgcataattaataaatgtttattcccttttctaaaatgaggaagtaaataatatggtaaatgacattttttctcttttttaaattatattcacaaggtagacttgtttccctctatatcagtaagcttgtttatttttaaactggctcaaggcaattgaagatatttcagataacagaagttaacctttccatcctcttggtattcaaattctttctcctttgataaaactttcaaagaaggttttcaatgtttattccaaatgatttcaagttgacgttataagttcaaattaaagtttgaattcaaatccaaacttcctaaacttttctaagacagtaaaataaccattgttctttaggctcacggacttcatagactgtcacgttttatttatttcaggtttgttgtttgccacaatagacattcttctctttgaaataaaataatatttcctctatttattccttgagataactctaaaatttattcattaaaagaatcgtcctttaagtataattttggaaaaaaagaaacttccaaagaggagatattaccccagaaggctggttttttttgtttttttttttttttaagtattccactttaaaaactcaggtgttacagttcactgagcataatgtattggatttctgggaattaaaggcaatgttatttgacaaagttctaattaactggttgtacagttaaaatttttttcttcaaattttctcatcagataacctctcaaatattttctcatcaaataacttcttagaaatggaggttttattttaaaaaagacagtgttacatttaatgctaggattgaaatcttcctaaagtgggagaataaataataatgatgtatttctctgaatgctttattgattccactacaatttgtccatgtgttaccatgtgttaccatacttggtatattatttcatatccagagtccattcagtcttataagagcttattaaatacatactaatacatatcaaattataaatgaatcagtgggcattctacattttacatcgtatatatgtacatatatatctacatataaatgctcaagcatttagttgttaagtgaacgcttttcattggcaagaaaaacttacttgatgtttaattggttcaggttgcatctcatgcacatacttaaacccgtaaatggcaagtggtatggaagcatataagcgaattaaagtatgattcattttctgtgacaaggggtagtctcatttctttactgaagactactgtgaaattgtgaggatggagatctgagcaaaatcagagttctattggaatggacacaggaatgagcctatctggtaggtgattaaggtatctgttacaacttgatacacaacaagaaatccagtaatattaattggtaagacattcttctagcatcacgatattaaatacgtccagaattcctataaaatctgtacattaagttaatttctttcaaaaattaacttttggttctagagtactttgatgtgtttccataactgacctgtcaggcctctgagcccaagctaagccatcatatcccctgtgacctgcatgtatacgcccagatggcctgaagtaactgaagaatcacaaaagaagtgaaaatggcctgttcctgccttaactgatgacattccaccacaaaagaagtggaaatggcctgttcctgccttaactgatgacattaccttgtgaaattccttctcctggctcatcctggctcaaaaagctcccccactgagcaccttgtgacccccactcctgcccaccagagaacaacccctctttgtaattttcctttacctaccgaaagcttataaaacggccccacccctatctcccttccctgactctcttttcggactcagcccgcctgcacccaggtgattaaaaagctttattgctcacacaaagcctgtttggtggtctcttcacacggacgcgactgaaatgacccattagaaaagcatacttacttatgtcttgcattttttgagctataatttttaaaaaatgtaaactcagaaatgtatggaatcactaaaaaaattatagaaaatgggatctcacagttatgtctttgtaactcatgcacattaaaagcaatcccaaataaaaataatgataaatctagcataataaatcattatttctttaaatatatttttcctaagaacagaacgataactcaaatttaagtgttccaaactgataagtcctcaggggaacactaaaagtgagagtaatttaaaagtagaatatcagtagattttagcaaaagaaaaattgatagtgctcattaggaatttatataatttattgaatcataattacactattgatttacataacagactcctttcacaggtaaactttctcctagagttttgtcatattttacaaattctaaatgagttagcccacttaaatgtttgtttcttaaaattttctagcacagaaaaatatgttaataacgttttaaaataataatgtagtgtgtttcttttgaataaagagactatcatgtagaaactgtcaggcctctgagcccaagctaagccatcatatcccctgtgatctgcacgtacacatccagattgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccctttttcctttatctacccaaatcctataaaacggccccacccctatctcccttcgctgactctcttttcggactcagcccacctgcacccaggtgaaataaacagctttatggctcacacaaagcctgtttggtggtctcttcacacggacgcgtatgaaagaaacatttaaccattcttaattcaaacacagacgcccaagtaagaaaagtgaatttataaaattgggtaaaattcacaagctgaattattagttcacaaactgaaatatcagtaataacctaaaatagtgtttattctcaaagacaatgtgaaaactctcattaggcattagaatctacttttcaaactcaaaagtgaatctccttgtaattatcagagctaaatatatgtaaacaaagtaactgatttagttaaagtgattaaacttttttcccattctcccccagttaaaatgaacagtggctaaaaattattatcttaaaggtttatccatagttccaattgcaacattttaaaacgtctattcctacatagaccattggaatagaatagagaagccagaagtgaagccaaatacttaaaaccaatttaccttcaacaaagcatacaaaaacataaattgggcaaaggacagcctattcaataaatggtgctgggaaaatgggacaaccacatgtggaagaatgaaactggatccctatctcctaccatatacaaaaattagctcaaggaggattaaagacttaagtctaagacctgaaaccataaaactcctcaaagaaaacctaggaaaaactctcctggacattggcctaggtaaagaatttatgaccaagacctcaaaagcaaatgcaacaaaaataaaaataaacaaatgggatctaagtaaactaaaaagcttctgcacagcaaaagaaataaccatcaacgtaaacagaaaaccgacagaatggaaaaaaatatttgcaaactgcatctgacaactgaccaatatctacaacctacaaagaactcaagcaaatcagcaagaagaaaacaatctctttaaaaagcttggaaacgacaagaatatacatttctcaaaagaagatatacaaatgatcaacaaatacatgaaaaaatacttaacatcactaatcatcaggggaatgcaaattaaaaccacaatgagatacttccttatcttagccagaatggccattattaaaaagtcaaaaaacaataaacgttggcatggacaagataaaaagagaacacttatatactgctggtggaagtgtaaattaatacctctctggaaaacagtatggagatttctcaaagaactagaagtaggtataccattcaatccacgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatggaaaatcaaatactgtgtgttctcacttataatgggaactaacttatgagtatgcaaaggcatacagagtgatataagggacttcagagactcagaagtggagggggtgggaatgagggataaaaaactacatattgggtacaacgtacactactcgggtgacggctcaataaaatcccggacttcaccattatacaattcatacacgtaagcaaaaaccacttgaaaccctaaagctattgaagtacaacaaaataaaaaataaaatgtatattccaataagaggaagtttgtagtcttatattcttattgctcagcaaattgtacattaagggcatattgaatattccataaaatatttttcactaatttaattactagtaatcatgtaaagccaaaacataaacattcacagggcttcctggtgatctatttcctcatattttttcctcctcattatttgcctcataatgttttgaacacatccactgtcttcaataagcttcccttacaacatcaaatgtgatttcacctattttcccctattcacttccaacagagattttagttggttatcagatcctgttgtggctgacaggcattagaaatagaaaattatcaagttacttgaggccatgaaattgagggccaaacacagatttccaaaaagcttgctgttttcgatatggttatgtcttcagcccacatcctgtcatgctagggcagttttccatttacagaagcaagtggctgtaaggttttgtggtagtcaggtagatgtcacagcgcaaacaggaattaactcaatacgtataaaagagaaagctttcgaaaagaagtttaaggccgggtgcagtgactcaacgcctgtaatcccagcactttcggaggcagaggtgggcggatcacctgaggtcaggagttcaagaccagcctggccaacatggtgaaaccccgtctctactaaaaatacaaaaattagctggctgtggtggcggatgcctgtaatcccagctactcgggaggctgaggcagaagaatctctttaactcaggaggcggaggttgcagtgagccgagatggcatcattgcactccagcctcggcaacaagagcgaagctctgtcccccccccccccccaacacacacaaaaaaaacagcaacaacaacaaaaaacaaagtttgtgtataatacatgccaagagggtaggaataaaataccatttgctgtcaagatatatttctaaacaagtttattaggaaggcagtagcagatatgaaaaaaaaataggatagggcactggaaataataaatttaaatcagcatttttttaaatttagaaattcataatctccaaccaacagaactaatacttaagtataatttccatggtaatgattatttaaaaccccatattgactatgaatttatagatggtgattccatatgcaaaaaagcaaacttgcatttataatagaaatgagaacaaagcaacagaatgtgtaatatgttgaaggagtcattaactttagtggaggacagtcaagttcctaaagattcatttatttattcattcattcagcaaaaaaatagaattatttagttcaggttataattccagattctttataaattaataatgactttaaatgcatgtgaatttcatagtactgtatatttttttatctaggaatatttttccttaaatgatactattctccgaatttaataaagtaccatttctactgatagattatgacttttaaaaaattggtttataattaaggaaaatatgaataaaaaggacaagctgattgattcattaagaggcaaaattatgctagatattgtatcaacaatatattgttttactaacaataaaactaatgtttccattaactaaaataaataattagaatgactaccatttttgaaatacgtagaacaaataacaaattttagtgcatttaatccctattttaattttattaggtttttttttcagttctactttacatacaagcaaacatgctgagctaagctaatacaaaataatacattttctgttgctgttgtttgtcttctgttttttgagacgaagtatccctctgtcacctgtcacctaggctgtagtgcagtggcatgatcttggctcactgtaacctctgcctctcggtttcaagggattcttttgcctcagcacccccgagtagctgggattaaaggcatgtgccaccaggccggctaatttttgtatttttagtacagacggggtttcactatgttggccaggctggctcaaactcctgatctcaggtgatcggaccgcctcagcctgccaaagtgctgggattacaggcatgatccaccgtgctgggcccagaataacacatttaagaagtgattttggctggccgcggtggctcacccctgtaatcccagccctttgtgaggcccaggagggcggattacctgaggtcaggagtttgagaccagcctggccaacatggtgaaacctcgtctctactacaaatacaaaaaattatccaggcatggtggagggccaactactcatgaggctgaggcaggagaattgcttgaacctgggaggtggaggttgcagtgagccgagatcgcgccgttgcactccagcctgggcaacaagagtgaaactccgtttcggaaaaaaaaaaaaaaagaagaagagagagaagtgatttaaacctaagtctgttcaattttaaaacttgtaatcttaaataaaaattatatttagaattatagtatcaattttattggccagttaaaattttaataaagtagatatatatgcaatttgtactatcagctatagatggcttgtttgaccacattttaatgtgttacatattttcatttagtatagttcatcctggaatattaagttccctagatcaaccactttttaatatatactcatgctattgttttgaaaattagagataactgtttagctttaacataaggctttagactggttaactagtagtgtccattcaggtccctgctggtttctgtttgaaatcaaggccaataataacggtcttaaagaggattattggaaaagttaagatgtgaaccttcttgctcaacaaagaatgcaagcaaaattgtcttaatctagaacagtttgaaaacactatcttagtctattagtgtattttttcagtccggtttgtttcttctgcttctttaaatcatagttgtttttctggatgaacttcattataatctggaaattcacattgacatttctcccagaaagccaaataaagcacacatttagaaagcctaagtacagcatctaaagcttccttgaccattataactgaataacagccgtgtagtgtagtgctaaaaaaaaaaaattattccagttacatggttcagtctcttgagatttacaggtagccaattatggcccacaggccagacaagtgactgatcgttgtctgaaaacaacgacgaagtggggaggtgaaaaagatttacggttttttttccccttacaggtagatgttgtttgaaataatgagatttaaaacgctaatgcagagctttgatctcttctttgatgtttcttgcctgttgtctatatgaaatatagtcagttaaaataaaaagccagagaatagtttctactcactaatgattaataaaaactgcttggcaaatgcaatcttgcacattgacaaatgaaaacagaataggatgcccaacaatggtttaaaaaaaaaaaaggtttttttgtttgtttctttgtttgtttacattgccacagtacactgctctttgttccctgaccctgcaagctctcaccgggtgacttcgactttgcacctacttttctcttttttagaatgccctctctcacatgttaccactagagaaacaatcacgtgtgcttcaaggccaaatcaaaaatttcctcttcagtcctttggactgagagagttatgcccaatttcacagcatatggtacaagcctctgttatttttctgtaccatggtattatatgtacttgcctgtgtctcttctagatatggggtccttaactatttttgtgctatggatccctttggcatctggtgaagcatatggaacacttcccagactgttttcaaatgtgcaaaatgaaaactaaaagcatataaaaaacaaaggaaattaattatattgcaattgtaaaatactgaatataatactattatatgctattaatacattagttataagcataataattaatacaaattaaaagtagtgattagtatactaaccactggtatatattaacatatgatttttcaagatatccaaaacaactaggatttgatataaaaatattggtaataaattcacagatattgctaataccgttctgtgttgcttatcttcataaagggaaagaaatgcaaattttcagttacaggttagtgaaaataaagatgtaatttttttcctatcatggttcatggaccccagattaaggacactgtattttgactgtatggcttcaagggcagagtttttatttgttcatctttgtgtctttagtacagaacagaaccatgggcacaatccaagcctattgaatggtggccgaattgtgtattgaacgttcaaatgtcagttctatcactgcccttatcacatcacaagagagaaatttgatgttcattaaaattaataattttaaaaaacattttaattaaaatatttattataattaaaatctgataaacttgtcaatgggtatgatacgtggcactgtgtatattcttttgcttatacacagatgcttgaaaattaaaattaaaaagctactgcaactaagcactcagcaattgtcatatttttctccacttttccctaagtcaataggcaaccatgaagttgacaatgttgctgataacattgtcatactcaacatcatttcccacaaagcttaaacctctacagaaactcagcagtccctacaacacatccttgaagaatgagaggggtgtcaataatttcagctgctcaaatggaaggctctgacatcaaggaatattaagtggcacattgaagggaattctactattaagtaatgaaggtgaggaaaacaatttctcaatccacggttatttctttgttatactaagaaccgtgcccaatacttatggaacaaaataagcctatcatttggacgtctcctatcagcctgaagcctgatgtcatataaaccaataatctgtgattgaatttttcagctttcagtgttttatttttagcataatatttggtattgccatacgtgacttattattctgttcaatttaatcaaattagagaataaacaaaacgacaaacataatttctcttaatgtgcgtgtgtgtttttcttttttgagacgaagtttcattcttgttgcccaggctcgattcgagtgcgatggcatagtgttggctcactgcaacctctgcctctggggttcaagggattctcctgactcagcctcccaagtaactgggattacaggtgcctgccaccacgcccggctgattttttttctatttttagtagagaccggggtttcaccatgttggccaggctggtctcaaactcctgacctcaagtgattcacctgcctcggcctcccaaagtgctgggattacaggcgtgagccagcatgcttggcttaatgtgttttaatgacataattccaacaaccatataactatattagtacaaaaagcaactacatgaaataaaaatctcaattgtttgccaaatggatacaaataatatatattacatatattatatataacatgcatataataaaatacacagtagtctgcctcttatccatggttttggttacccatgatcaactgcagtccaaaaatagatgagtacagtacaataagatattttgagagatagagaccacattcacataacttttatcacagtatattgttataattgttctaatattagttattgttgttaatctcttatggttcctaatgtatatattaaactttgttatatgtgtatgtatataagaaacataatatatacataaggtttggtattatccacagtttcaggcatccaccaggggtcttagaacacgtatccctacagataaggggagattaattatttctaccattacagaattaaaatgagtctgtgttaatcttcctattcaaaaattatttctaattcagagaaattcaaagagagtctataacgctatgcggtttattgacattaaagacattaatagttaattgcttgaagaagaaaatagactttttcagtaataataacaaatttgcagcataattggaagtgtaccgtcctatccccctttgaactataaaataatattttggtaaaatatggtgaaggatccttacagtgtatcttgatcatagtcctcctgagttataattatctacattattatactaaaattgtggctcttcctcataagatattaatatattcactatatgaaattaactaattgcatagctccaataaaatattaacttattcaactgttaaagtaagaatatcggccaggcgcggtggctcgtgcctgtaatcccagcactttgggaggctgacacaggagaatcacttgaacctgggaggcagaggttgcagtgagccaagactgcgccattgcactccagtttgggcaacagtgagactccatctcaaaaaaataaataaaataaataaagtaaaaatattaattgcatacaaaaaagaaatatgctggataccgtccattgtattagcaatttcaaggctaaacattacttttttttttttttttgagatggaattttgctcttgtcgcccaggctggagtgcagcggctcaatctcggctcactgcgacctctgcctcccaagttcaagagattctcctgcctcagcctccctagtagctggaataacaggcgcccgccaccatgcctggctaattttctttgtatttttagtagagacggggtttcaccatgttggccaggctggtctcaaactcctgacctcaggtgatccgcacgcctcagccgcccaaagtgctgggattacaggcatgagccaccgtgcccggcctcaacattactttcgatctcaagactggaagtgcagtactcaacaaagtaattggggaaaaaaatagtttttgatgtaaaaattttagagttcttgatctttgaatgaagttggtctcccaataaatttcaaacgaataagaaacattagatttgtttccttctggctctagtatataggaaagacatttgcaaagcaggtattccaaaatatgaggcaaaatcatcattcttgcccccccccccaaaaaaatcttctagcaactgttgtaacacagagccattataatgtaattagacagactaagaaccagatgctaaggaagcaaaatataaaagatgaagcatgatattattttggttaatgaatttaattccaaatgttacaggagtgattcatggactttttttttcccaaaagatcagttgtcacatgtacatattgcattttaacatgatgtttatgtaatctaatgagaaaagtaaattctcatgtaatattagatgtttcgaaatggataaactgcagacacttccacgggtagatgaataattcgtcaatagtgataagttaatctttaaacttacccctcaaaatggttaagagttaggttatactataaatgtaatataattccataaaaataaccaagacaaaaaatactttagaaatattgaaaatataatatttgttttcctctaatatcctcaatctggtattattgtgtaattcgaatatatggcaatattattattatttttttttttttttgagacagaatctcacttttttgcccaggctggagtgcagtggcatgttcttggcttactgcagcctccacctcccgggttcaagcgattctcctgtctcagcctcccgagtagctgagattacagatgcccaccaccacgcctggctaaattttgtatttttagtagagacggggtttcaccatgttggccaggctggtctcgaactcctgacctcaggtgatccgcctgcctcagactcccaaagtgctgatattacaggtgtgagccaccaccgtgcccggccagcaaaataattcttaaaattcaacttaaaaattactccaagaaatgtgtaggtaaaagtcaaaacactttagtaaatccacattttgtatttccatttatagtaacctctagtgctcattattttgaagataaaactttcttatacagtaagctttttaaaatgtgagaccaaatcaaacaacaagagcgtaatgaaaaacgatagaaggaaaacaactaaaataagaacctcctagctcagatttattctaaaaagttgaaaataaatataatgtagaagttattattatgaaaacataaataataatattttttcatagatagtaacactagctttactctgaaagtagaatctgtgcttcattaatagtgcctgtgtttaacactttgataactcaccatacagaagtatagcctcagtgttcccagattcctgttcctagggatgaatgatcacattaggaaggtacattcctgttaatttggctaaatctgccagcccaaatcataaagttctcctaaagatgctctatctcaagagcaaacacttaggaaaattgttaatgtttataacaaggcaatcaacatctcatttaaatattcagaaattgatccttccacttcatactttcagttaggatgagcattgaaaacatgtagtaaagcacaacctcagcattcataatgaatatgataagaacaagccttttctcattcatgtttactaccaaacatctgttgaataaactacttaatccttacaaacataaccagattattttcagcaacaatacaaactctatagtgataacagctggtcctttactttcttcagggatatacactccacatatatttcatttcttctcaagttaagtgacaaaaagctaaaatggattgtgatgcagtcaaagccacgaatgacacagttttctaccatagacaaggggataattttttttttctttcaatgtaagccacaagtgtaatggggggatctcctaaacgaaaggcattatggtagggggaggttccttttcaagaccacgcctaaactactgataaatatgataaatatatggttgtaaaagacaacatttctttttttttttttcgagatggagtctcgctctgtggcccaggctggagctcagtggcgtggtctcggctcactgcaagctccgcctcctgggttcacgccattctcctgcctcagcctcctgagtagctgggactacaggcgcccgcaaccacgcccggctaattttttgtatttttagtagatacggggtttgtatcactgtgttagccaggatggtctcgatctcctgacctcgtgatccgccggcctcccaaagtgctgggattacaggcgtgagccactgcgcccggccaaaagaaaacgtttctatgaacacagtattacttatacaatatttaaaaacatattatttgatgctcaatgttttataaacaatgattcaaaaatgcagagctgggtgagcacggcggctcatgcctgtaatcccagcactttgggaggccgaggacagaggatcacctgaggtcagcagttcgagaccagcctggcccacatggtgaaacccatctctactaaaaatacaaaaattggccaggcatggtggcgtgcaccagtaatccctgctattcgggaggctgaggcagaaaaatcgcttgaacccaggaggcagaggttgcagtgagccgagatggtgccactgcactgcagcctgcgagacagagtgaaacccagtctcaaaaaaaccaaaacaacgacaaaaaaccacagggctggccgggcacagtggctcacacctgtaatcccagcactttgggaagctgaggcaggtgggtcacctgagctcgggagtttgagatcagcctgagtgataaggcaaaaccccatctctacaaaaagtacgaaaattagctgggtgtggtggagcgctggtagtcccagctactcgggaggctgaggtgggaggatcacttgaactcaggaggtcaagggttcagtcagccatgatcgaccactgcactccatcctggatgacagagaaaaaaaatgcagagctactgaggtatttacaaagaaatataaagcacagcacgtgctctcaggaaatctataaaaaagttaaaaagttatggaatcaaagttaatccacaggaaataattagcaagcaattatgtcgataactgggtagaaataactatgtggaacaaaagttcatagaaaaaagaggtgtttcaagccgttagagaaagtgttgtggtaactaggacttgaattgaatttttgaagatgggaatgctttagaaccaaaagtcgatggaggaaaaagattccagaaagggggaatcagactagaaaagcaagaataaatgagctggcctgtataggagagagaatattttatgcagagtatatagataaagtaacacagttcaaacccttaaaagtgtatagccagcatagttttctgccaggattcatactgctctcaaatcagaagatactctactagatttaagaattacatagtcaatcagctgaaagccttggaactttcggctacatagtcattaaaaacactactattatagctcaatttcaccaggccacattatatatatatatattttttaacataatgtacacaatacatatatacaattttgccaattaaacttgtttttcaaaaagtaactcattttatctaaagaagttaagctcatcaaagcaaagtggaacagtggtagccagtaactggggatggaaaaaaatggggaaatgctggtcgaaggatagaaactctcagttataagatgagtaagctctggggatctaatgtacagcatgttgactatagttaatagtactctattgttacttgaaatttgctaagagagatcttaagtgttctcatcataaaaaattataatggcaactatgtgaggtgaaggatatattaattaacttgattgtgataatcatttcagaatgtatatgtatcaaatcatcatattgtacaccttgaatatacccaatcgccatttgtcaattatacctcaataaagctgggggaaaaggtacctcatatttattattacattttattgttataacacatatattttatctcatttgacccttgaagtaactgaacctaaaaagcagtatttttagatatgaaaactgaggcccattgaggattaatgattctcaaagccacagggtaagcagtaaagttacaactcctctcatgtgtcctgattacaaatcattacctaacgtctgtaatttccttgcatcatcgagaacctgaaacttttatcataaaaacatttctaggaaatctggtaccatacgctaatcaactatggaaagaaaatccatttttaaaggagtatctcaacttgttgcaatttgcacataaaaatatcctttgtctcatatactacgggacaaaacagaagcagaaacaatgaaataggttcaccattagagatctgactagtcttgaaatgtagacaattcaggtcattagtcatggagtcctaaggggaaaaagcatgcctgattccacactagtaaagccagaagctatctaatttacatcctatacttggctgaggatatcagatgtgttcaggctgaacaagttcaagactcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtggagacggggtttcaccgtgttagccaggatggtctcgatctcctgacctcgtgatccgcccgcctcggcctcccaaagtgctgggattacaggcgtgagccaccgcgcccggccaagactcttgcttgagtaatttaaagggatgtgacacagtctgaatagtaattggttatttaataatcctgcctgcagtggcaacataagcttgctttactcttaagcactggataggacaaactgtcttactcagtcctaggaaaagaaacgttcatctgaacaaaagatttaaagtcgacctgatgtgaaatcctgaaatacattttgaaaatgaatggattagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctactttgactttttggcctttctcagcatgcttcttcaccactgtggaagagcttcccagtacaactactactactgccaaccacaacctccatatctgacactaaatccttgcctactaaactgctcattatctttaaaattggcatcactcacttctacttcacacatccactgttcgatatccagccaagcctggactctgactgatcacttcagtgctacatacaaagacaccttagactttacttccttgaactttattgaacatctttacttccttgaacacattgtatatataatagagaaggaggcatataacatgacatatgtcaaaaatatgtcatatatgtcatatatatgttttatatatatatatacacacacacacatataaaatgagctcaaggaagtaaagaattgtaagtattgtcttctttctccaatacctactcctctttgctaaggcatcagatgatgttgtttgtgactcagtaaatcactattatccaccatcaactgaaccatgctgttactctttcccattagtttattccgcaaatacatattaagctactactgcgtgactgacaatatgcatgttagtgtatattcagtggcgatcaaggcagttagaggatggatgaggagagcattccaggaagaggcaatagcagtacagagactggcatttgagaaatggcagcaggtcagtatggctgaaatgcagcaagactgcagaagaaaaggaagaaaaatgaagtgtggttcttggtaaagatattggacgcatcagagcagtaacgaattttaatcagagattgacacaacctggtttatgtttttaaaagctcaacctttaggccatgtagagtatggagtgagtagaaaaggacaaaagcacaagtggcaaagatgagttgggggattattgtagtatctaagggtaaattagactaggatggaaacaaaatatatggatgatatatgtccattttctctgctgttccatgagccttttcttcacttactgggctatctggtccatctcccataaccagtcttctaacccttcctattgatttgcaggttcactaactgtttcctttcgatccacctcctgttcacttttaggtactaaacagagtgaagtcatcccgtgtgagtttcctcaccctccctccctctaacatcttaagtgcctttgccctgttttgtttaagcatgtgaaacaatttctcgctaaccttctgtgttactttagattctccccagacagacactgaggcaaggatttgaggtgcaggtacacagtttatctggcaattgattacaaaaagtacaagtgagaggaaagagaaagtgagattaggaaaggtaaggaggcaatcaaaggtgtgtcaatgagcacattattctggggctcagtcctgctggtgaatctctgagaagctgtgaggaacatgcctcagaattatgcaccagaagatgagatggctgcgtgcttttttcaagtacttccatcccctcgtagttaaaggtcgcttctggtgacattaacacaacccctcatatttctggcttactcctgtttatagcaaagcaagatactgcatggaactcgggtggggaaagaaatatgcggcagaacatcagcaacaacttttacatcttcttatcccttcaggatcttgtttatttctctcctctattgaaacactttttaggccaggcacagtggctcacgcctgtaatcccagcactttgggaggccgaggcaggcggatcacctgaggtcaggagttcaagaccagcctggccaacgtggcgaaaccccgtctctactaaaaatacaaaaattagccaggtgtggtggcgtgtgcctataatcccagctactcgggaggctgaggcaggagaatcgcttgaaacagggaggcggaggttgcagtgagctgagatcgtgccactgcactccagcctgggtgacagagcatgactctctcaaaaaaaaaaaaaaaaaaaaaaaaaaagactttttaaaggggttattattaggggctatatactggatcttataaatcatctagtccaaccctattatgtgaagattagaaaacaaagcattcacattattctatcgatttttggaatgctatttgcaaacttttttctgggcccacttaaatgtataagttttccatattttatgttggttaataagattaaaaccaattttaatatcttgacaccacattgccatttatcaatatgtactacgttttttactggttcctcaaatctcaaatctgtgccagcgtctgttgaatttttataattttgactcaatttatcattcttttttttttttttattgagacggagtcttcctctgtctctcaggctggagtgcagtggcactatcttggctcaccgaaacctccgcctcccaggttcaagtgattctcctgcctcagcctccctagtagctgggactacaggcgcatgccaccatgtctggttaatttttttgtatttttggtagagacggggtttcaccatgttggccaggcaggtctcgacatcctgacctcaagtaatccgcccaccttggcctctcaaaatgttgggattacaggcgtgagccaccacgcctggcctatcattcttttttaatttgcagacttttaagaacaggctaatttgagacacagaaccacaaaagctacttacgttccaaaatgctctgcagaatctctttttgcatgtgctacgtatggcctttgggagaagtacattttttgtagttgttttgtggttttttgaaatgactagaaatatttttagggccctagaaacctccaaggtaagtgtttagaaattgtgcttctaggaatctgtcagtacttttgtaaacattatctgaagcataagcataaacaaatttgaacagcaggctagctcacacagaaatgattttattcattggaatgttctcacatgtggtatactttatttttagtttggtttcatttatgattaataattatgattccaaaggtgcttaaatcagccggccatggtggttcatgcctgtaatctcaacactttgggaggccgagatgggcagatcacttgaggtcaggagttcgagaccagcctggccaacagggtgaaaccccgtctctcctaaaaatataaaaattagtcaggcacggtggtgcatgcctgtaatcccagttactgaggaggctcaggcaggagaattgcttgagcctggaggtggaggttgcagggagccgagattgcaccagtgagctccagcctgggtgacagagtgagactccgtctcaaaaacaaacaaacaaacaaacaaaaaacaaaaaacaaaaatcaaaggtggtgaaataattttgttgaatatttggcactgtctacattaatgcacacactcaatgtatatattttaacttaatttatacttaaaattgtataaaattattttagtcaaagaacctaatgcagcttagccttgattgataatttcattatctttaattacatggcagaatttctcctcattactctttaaccaaaaggctgtggtagaaatcattgatgctcatttttattggaaagtaatttttctagatttcctgataattgagtgataacttcagcactccttagtcacttttcattatgcagacaaaatctgactcttaactttcaaaaaaatatcttaccataatgtattttcaaataacatgagtttaattaaaaagaactttcccacaggttcatgtttaatcttggtttgagtcttgaatatagagtgaagcgaagtacaactttttctgctttggacaaatttagagctgcttgaagagataaaaacaagcggggacctccctctaaaccttccacttctctttctctccctctctcaactgtgttccgaatgctttctctaaaacacagaggctgagttttgactggctggaaaaacatcagtttatttcatgttcttcctttctccagcttccatttcaattccaagtgtggcccaaaagaaaagataggaactgcataaggatgtttcagtcaatgataaactgcatataccgcagtggtcccatttgattataacacgggatttttactgtaccttctaatggttagatatgttttagacattgaaatatttaccattgtgctacagttgcctacagtattcagtacagtcacatgctgtacaggtttgtagccaaacagaaataggatataccatacaacctaggtctgcactacgctataccacgtaggttagtgtaagtacactctgtgacattcacacaacgatgaaattaccttagtatggattgatcagaatgtatccctggtgttaacacataactgtatatatcctgtgtgtgtttgtgtgtcactgaagagatatgattccttcaccatgaggaatcagaaaactgaaaaggtaaacaaattattgtatcctgaaagtctcaaatgagtttttgttctactttcttttgtttttttttgagacagaatctacctctgtcgcccaggctggagtgcaggggtgcgatctcggttcaatgcaacctccgcctcccgggttcaagcaattctcctgcctcagcctcccgagtagctgggatttcaggaacctgccaccacaacctggctaatttttgtatttttaggagagacagggtttcgccatgttggccaggctggtctcaaactcctgacctcaagtgatctgtacacctcagcctcccaaattgctgggattacaggtatgagccaccacgcccggttcaaatgagtttttttttttttttttcagtccaatattaaaacaaacgaaaaccagaatgccttttgttctcacattcaattcataatctaatagctatcagaataaaatgtcatatttattattcatttggaagaaaacaaacagcagtaaaaattgaaataaaaggctgggcgttgtgagtcactcctataatcccaacactttgggaggccgaggtgggcggatcacttgaggacaggagttagagaccagcttggccaacatggtgaaaccctgtctctaataaaaatacaaaaaaattagctgggcgtagtggcgaatgcttatatcccagttacttgggaggctgaggcagaagaattgcttgaacccaggaggcggaggttgcagtgagcccagatagtgccattgcacttcagcctgggcgacagagggagacgctgtctcaaaaaaataaaataaaaataaaaataccctggccaggcacggtggctcacgcctgtaaccccagcactttgggaggccaaggcatgcgaatcacgaggtcaggagttagaaacaagcctggccaacatggtgaaacctcggctctactaaaaatacaaacattagctgggcgtggtggcaggcgcctgtagtcccagctattcgggaggctgacgcaggagaatcacttgaacctgaagggcggaggttgcagtgagccgagatcgtgccactgcactccagcctgggcgaatagagggagactctgtctgaaaaaaaaaaaaaaaaaaaaaaaaaaaaaaaaaaccgaaagaaataaaaataccctgtctttattttcttccttggcaaaattgtctgtaggattcactcatccatttatttaattaatttattgaattcccattacattccaagcaggtattaactactaaggattcaatgatgaaagacaaggtgtataggagacctagtacgtacagccttagtttcttttctcagatttatgctctaaaattccgttaagaatggatttattggctgggtgcggtggctcacgcctgtaatcccagcactttgggaggcagaggcaggtggctcacctgaggtcaggagttcgagaccagcctgaccaacatggagaaactccgtctctcctaaaaatacaaaattagcttggtgtggtggtgcatgcctgtaatcccagctactcgggaggctgaggcaggagaattgcttgaacccaagaggcggaggttgcggtgagcctaaatctcgccattgcactccagcctgggcaacaagagcgaaagtccatctaaaaaaaaaaaaaaaaaaaaaaaaaaggctttatttttatgaagaaaaccataaattaatgtcataaatcttatctatgttaataattatcagttgctttaatcatgaaaacaaaagggaaaaactggcaagtgagccaggctgaaataattcaatataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagaccaaatgagagagaagacttgcaaaagggtaacttttcttacaaatcaagttatgggaaaatttgagatccaaatagacttttaactttggattgtctttattcccaacacacgtttttaatttaatgcggtgtactttatcctaactcttttagctcacccccctgaaaaaaaaactagctgtcttcctaaagatagagaaaacttgtccaagtcagaaactctttggaattttaataaaagtaacataatttagaaattaatatacttcaaatatactgacagtatatattggcaacagaatatatgctaatttagaattttaggatattctataattaaaaaaaaacctgataaatcactacaccttttcactttatttagaagctaccatttaataataagtgtttaacctctaaaatcattctgagatatttcagataattaggcagcctggaattactgtttacaattgtcccagtttgcttcctaataagttgtgcttgtctaaacatgtctaaattactattcacaaggatccttgttatttccgtcttctttgattaaaaacttcttaaaaatgtgagtgtatatgtgtatgtatatatatacacatacacatattcatatgtacatatatgcataaataagcccatatatatatgtgaaacacaggtttttctattgttaatataaaaatccctcattagttttctaatgagtttatgaatgtagtctacgtccttagaaatttaatttgaggtaaaaatattatcgtttatagattaaggtctggatatttttttcttttcttcatactagaaataattttagatacctgaagacaaagttcattaaagccacaacccaaaaagtagaatatgggttccttcttatttcagtgatttgcattatcctataggttattggtgtcaaacccctttcttcccttcctcacaacaaaagccccaatttaacttttatagaaaggcatatggaacaggagtcatccaaatatatcccaggggttgcaaattgaccaaaagagtcacctttagggaagcctgcttctgaatgcttgtggaatttatcattcttctgaatggctgttgcatttatctgcagcttttactcaccagatgagacctcagacatttcaaattctgcggaggctggctacacaccttcataggaaagctttttgctgatttccctgttggtacttttctcttacacattctatggggtatggtaaacctggaggtagagtcatagccaagcacagataaagcaggcacagaatctctgaccagcctcacaaaagcagacaaacacacaatctttttgcacctgtttcttccactccggttgccgtgaatagtgaggtgttctcacagattcagcttcacagacagca

SEQ ID NO: 1860 - DNA, 1293028 bp, Homo sapiens; identical to SEQ ID NO: 1858
